United States Patent 12,569,549 (FLAVIVIRUS VACCINE) - sequence listing, part 21

SEQ ID NO: 9451 - RNA, 9876 nt, synthetic construct
  misc_feature 1..9876: note = derived and/or modified CDS sequence (opt1) from DENV-2__EU482728__SS-prME
  source 1..9876: mol_type = other RNA
accgccggcgtgatcatcatgctgatccccaccgccatggcgttccacctcaccacccggaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagctccgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccctcgtggaccggggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctggacttcaacgagatggtgctcctgcagatggaggacaaggcctggctggtccaccggcagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcgcggcgccaagcggatggccatcctcggggacaccgcctgggacttcggcagcctcggcggggtgttcacctccatcgggaaggccctgcaccaggtcttcggggcgatctacggcgccgccttcagcggggtgtcctggaccatgaagatcctgatcggcgtgatcatcacgtggatcgggatgaacagccgctccaccagcctctccgtcagcctggtgctggtgggcgtcgtgaccctctacctgggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctcgcgtccgccatccagaaggcccacgaggagggcatctgcgggatccggagcgtgacccgcctggagaacctgatgtggaagcagatcacccccgagctcaaccacatcctgtccgagaacgaggtgaagctgacgatcatgaccggcgacatcaaggggatcatgcaggccggcaagcggagcctccgcccgcagcccaccgagctgaagtactcctggaagacctggggcaaggccaagatgctgagcacggagtcccacaaccagaccttcctcatcgacgggcccgagaccgcggagtgcccgaacaccaaccgggcctggaacagcctggaggtcgaggactacggcttcggggtgttctccacgaacatctggctgaagctccgcgagaagcaggacgtgttctgcgacagcaagctgatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctctggagcaacggcgtgctggagtccgagatgatcatccccaagaacttcgccgggcccgtgagccagcacaactaccgcccgggctaccacacccagaccgccgggccctggcacctgggcaagctcgagatggacttcgacttctgcgaggggacgaccgtggtggtcaccgaggactgcggcaaccggggccccagcctgcgcaccacgaccgcgtccgggaagctgatcaccgagtggtgctgccggagctgcaccctgccgcccctgcgctaccggggcgaggacgggtgctggtacggcatggagatccgccccctgaaggagaaggaggagaacctcgtgaactccctggtgacggccgggcacggccagatcgacaacttcagcctgggcgtcctcgggatggccctgttcctggaggagatgctccggacccgcgtgggcaccaagcacgccatcctgctggtggcggtctccttcgtgaccctcatcacggggaacatgagcttccgggacctgggccgcgtgatggtcatggtgggggccaccatgaccgacgacatcggcatgggcgtgacctacctggccctcctggccgccttcaaggtccgccccacgttcgcggccgggctgctcctgcggaagctgacctccaaggagctcatgatggccaccatcggcatcgccctgctgagccagtccaccatccccgagacgatcctcgagctgaccgacgccctggcgctcgggatgatggtgctgaagatcgtgcgcaacatggagaagtaccagctggccgtcaccatcatggccatcagctgcgtgcccaacgccgtgatcctccagaacgcctggaaggtctcctgcaccatcctggcggccgtgagcgtcagccccctgctcctgacgagctcccagcagaaggccgactggatccccctggccctcaccatcaagggcctgaaccccaccgcgatcttcctgaccacgctcagccggacctccaagaagcgcagctggccgctgaacgaggccgtgatggccgtgggcatggtctccatcctggccagcagcctcctgaagaacgacatccccatgaccgggcccctggtggccggcgggctcctgaccgtgtgctacgtcctgacgggccggtccgcggacctcgagctggagcgcgccgccgacgtgaagtgggaggaccaggccgagatcagcgggtccagccccatcctgtccatcaccatcagcgaggacggctccatgagcatcaagaacgaggaggaggagcagaccctcaccatcctgatccggacgggcctgctcgtgatctccggggtcttcccggtgagcatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctacagccagatcggcgcgggggtctacaaggagggcaccttccacaccatgtggcacgtgacccgcggggccgtgctgatgcaccgcggcaagcggatcgagccctcctgggccgacgtcaagaaggacctgatcagctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgtccctggacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctctcccccgtccgcgtgccgaactacaacctgatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctctcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctgaccgacggcgaggagcgggtcatcctggcggggcccatgccggtgacccacagctccgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctactccgaccccctggccctgaaggagttcaaggagttcgccgcgggccgcaagagcctcaccctgaacctgatcaccgagatggggcggctccccacgttcatgacccagaaggcccgggacgccctggacaacctggccgtcctccacaccgccgaggtgggcgggcgcgcgtacaaccacgccctgtccgagctgcccgagaccctcgagacgctgctgctcctgaccctgctcgccaccgtgaccggcggcatcttcctgttcctgatgagcgggaagggcatcgggaagatgacgctcggcatgtgctgcatcatcaccgcctccatcctgctgtggtacgcccagatccagccgcactggatcgcggccagcatcatcctcgagttcttcctgatcgtcctgctcatccccgagcccgagaagcagcggacgccccaggacaaccagctgacctacgtggtgatcgccatcctgaccgtcgtggccgccacgatggcgaacgagatggggttcctcgagaagaccaagaaggacctgggcctgggcagcatcaccacccaggagtccgagagcaacatcctcgacatcgacctgcgcccggcctccgcctggacgctgtacgccgtggccaccaccttcgtcacccccatgctccggcacagcatcgagaactccagcgtgaacgtgtccctgacggcgatcgccaaccaggccaccgtcctgatggggctcggccgcgggtggcccctgagcaagatggacatcggcgtgcccctgctcgccatcgggtgctactcccaggtgaacccgatcaccctgaccgcggccctgctcctgctggtcgcccactacgccatcatcggccccggcctccaggccaaggcgacgcgcgaggcccagaagcgggccgccgccgggatcatgaagaaccccaccgtggacggcatcaccgtgatcgacctggagcccatcccgtacgaccccaagttcgagaagcagctggggcaggtcatgctcctggtgctgtgcgtgacccaggtcctcatgatgcgcacgacctgggcgctgtgcgaggccctgaccctcgccaccggccccatcagcacgctgtgggaggggaaccccggccggttctggaacaccaccatcgccgtgtccatggccaacatcttccgcggcagctacctggcgggggccggcctcctgttctccatcatgaagaacaccacgaacacccggcgcgggaccggcaacatcggcgagaccctgggggagaagtggaagtcccggctcaacgccctgggcaagtccgagttccagatctacaagaagtccgggatccaggaggtggaccgcacgctggccaaggagggcatcaagcgcggggagaccgaccaccacgcggtctcccgcggcagcgccaagctccggtggttcgtggagcgcaacatggtgaccccggagggcaaggtcgtggacctggggtgcggccgcgggggctggtcctactactgcgggggcctgaagaacgtgcgcgaggtcaagggcctcaccaagggcggccccgggcacgaggagcccatccccatgagcacgtacggctggaacctggtgcggctgcagagcggggtggacgtcttcttcaccccgcccgagaagtgcgacaccctcctgtgcgacatcggcgagtccagccccaaccccaccatcgaggccggccgcacgctgcgggtgctcaacctggtggagaactggctgaacaacaacacccagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgccaccgggaacatcgtgtccagcgtgaacatgatctcccgcatgctcatcaaccggttcacgatgaagcacaagaaggcgacctacgagccggacgtcgacctgggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtccgcctcctgaccaagccctgggacgtggtgccgatggtcacgcagatggccatgaccgacaccacccccttcggccagcagcgggtgttcaaggagaaggtggacacgcgcacccaggagcccaaggagggcaccaagaagctgatgcggatcaccgccgagtggctctggaaggagctggggaagaagaagacgccccgcatgtgcacccgggaggagttcacccgcaaggtccggagcaacgcggccctgggcgccatcttcaccgacgagaacaagtggaagtccgcccgcgaggccgtggaggacagccggttctgggagctcgtcgaccgcgagcggaacctgcacctggaggggaagtgcgagacgtgcgtgtacaacatgatgggcaagcgcgagaagaagctcggggagttcggcaaggcgaagggctcccgggccatctggtacatgtggctgggggcccgcttcctggagttcgaggccctcggcttcctgaacgaggaccactggttcagccgggggaacagcctgtccggcgtggagggggagggcctccacaagctgggctacatcctgcgcgacgtcagcaagaaggagggcggcgcgatgtacgccgacgacaccgccgggtgggacacccggatcaccctcgaggacctgaagaacgaggagatggtgacgaaccacatgaagggcgagcacaagaagctggccgaggccatcttcaagctcacctaccagaacaaggtggtccgcgtgcagcgcccgacgccccgggggaccgtgatggacatcatctcccgcaaggaccagcggggcagcggccaggtcgggacctacggcctgaacaccttcaccaacatggaggcgcagctgatccgccagatggagggggagggcatcttcaagtccatccagcggctcaccgtgacggaggagatcgccgtgcagaactggctggcccgcgtcggccgggagcgcctgagccggatggccatctccggggacgactgcgtggtgaagcccctcgacgaccgcttcgccagcgcgctgaccgccctgaacgacatgggcaaggtccggaaggacatccagcagtgggagccctcccgcgggtggaacgactggacccaggtgccgttctgcagccaccacttccacgagctcgtgatgaaggacggccgggtcctggtggtgccctgccgcaaccaggacgagctgatcgggcgggcccgcatctcccagggcgccggctggagcctcaaggagaccgcctgcctggggaagtcctacgcgcagatgtggacgctgatgtacttccaccggcgcgacctccggctggccgccaacgccatctgcagcgccgtcccctcccactgggtgcccaccagccgcaccacctggtccatccacgcgaagcacgagtggatgaccacggaggacatgctggccgtgtggaaccgcgtctggatccaggagaacccgtggatggaggacaagacccccgtggagagctgggaggaggtgccctacctcggcaagcgggaggaccagtggtgcgggagcctgatcggcctgacctcccgcgccacctgggccaagaacatccagacggcgatcaaccaggtccggagcctcatcgggaacgaggagtacaccgactacatgccctccatgaagcgcttccggaaggaggaggaggaggccggcgtgctgtggtga

SEQ ID NO: 9452 - RNA, 9876 nt, synthetic construct
  misc_feature 1..9876: note = derived and/or modified CDS sequence (opt1) from DENV-2__EU482729__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgagatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagatcgccgggccctggcacctgggcaagctggagatggacttcgacttctgcgaggggaccacggtggtggtcaccgaggactgcggcaaccggggccccagcctccgcaccaccacggcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacgcgcgtgggcaccaagcacgccatcctcctgatcgcggtgtccttcgtcaccctgatcaccgggaacatgagcttccgggacctcggccgcgtgatggtgatggtcggggccacgatgaccgacgacatcggcatgggcgtgacctacctggccctgctcgccgccttcaaggtgcgccccaccttcgcggccgggctgctgctccggaagctgacgtccaaggagctgatgatggccaccatcggcatcgccctcctgagccagtccaccatccccgagaccatcctggagctcacggacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcaccagctcccagcagaaggccgactggatccccctggccctgacgatcaagggcctcaaccccaccgcgatcttcctgaccaccctgagccggacgtccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgaccggccggtccgcggacctggagctcgagcgcgccgccgacgtcaagtgggaggaccaggccgagatcagcgggtccagccccatcctgtccatcacgatcagcgaggacggctccatgagcatcaagaacgaggaggaggagcagaccctgaccatcctcatccggaccggcctgctggtgatctccggggtgttcccggtcagcatccccatcacggccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagaccaagcccggcctgttcaagacgaacaccgggaccatcggcgcggtctccctcgacttcagccccggcacctccgggagccccatcgtggaccggaagggcaaggtggtcgggctgtacggcaacggcgtggtgacgcgctccggggcctacgtcagcgccatcgcccagaccgagaagtccatcgaggacaaccccgagatcgaggacgacatcttccggaagaagcgcctgaccatcatggacctccaccccggcgcggggaagaccaagcggtacctgcccgccatcgtgcgcgaggccatcaagcggggcctgcgcacgctgatcctcgccccgacccgcgtggtcgccgcggagatggaggaggccctgcgggggctgcccatccgctaccagacccccgccatccgggccgagcacaccggccgcgagatcgtggacctcatgtgccacgccacgttcaccatgcggctgctgtcccccgtgcgcgtcccgaactacaacctcatcatcatggacgaggcgcacttcaccgaccccgccagcatcgccgcccggggctacatctccacccgcgtggagatgggggaggccgcgggcatcttcatgacggccacgccgcccgggagccgggacccgttcccccagtccaacgcccccatcatggacgaggagcgcgagatccccgagcggagctggaactccggccacgagtgggtgaccgacttcaaggggaagaccgtctggttcgtgccgagcatcaaggccggcaacgacatcgcggcctgcctgcgcaagaacggcaagaaggtgatccagctgtcccggaagacgttcgacagcgagtacgtcaagacccgcgccaacgactgggacttcgtggtgaccaccgacatctccgagatgggggccaacttccgggccgagcgcgtcatcgacccccggcgctgcatgaagcccgtgatcctcacggacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcctactggaaggaggccaagatgctcctggacaacatcaacacccccgagggcatcatcccgagcatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggacgaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccaccttcatgacgcagaaggcccgggacgccctcgacaacctggccgtgctgcacaccgccgaggtcggcgggcgcgcgtacaaccacgccctctccgagctgcccgagaccctggagaccctcctgctgctcacgctgctggccaccgtgaccggcggcatcttcctcttcctgatgagcgggaagggcatcgggaagatgaccctgggcatgtgctgcatcatcacggcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccaccatggcgaacgagatggggttcctggagaagacgaagaaggacctcggcctgggcagcatcaccacccaggagtccgagagcaacatcctggacatcgacctccgcccggcctccgcctggaccctgtacgccgtggccacgaccttcgtgacccccatgctgcggcacagcatcgagaactccagcgtcaacgtgtccctcaccgcgatcgccaaccaggccacggtgctgatggggctgggccgcgggtggcccctcagcaagatggacatcggcgtccccctgctggccatcgggtgctactcccaggtgaacccgatcaccctcaccgcggccctgctgctcctggtggcccactacgccatcatcggccccggcctgcaggccaaggcgacccgcgaggcccagaagcgggccgccgccgggatcatgaagaaccccacggtcgacggcatcaccgtgatcgacctcgagcccatcccgtacgaccccaagttcgagaagcagctgggccaggtgatgctgctcgtcctgtgcgtgacccaggtgctgatgatgcgcaccacgtgggcgctctgcgaggccctgaccctggccaccggccccatcagcaccctctgggaggggaaccccggccggttctggaacacgaccatcgccgtctccatggccaacatcttccgcggcagctacctggcgggggccggcctcctcttctccatcatgaagaacaccaccaacacgcggcgcgggaccggcaacaccggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtgtcccgcggcagcgccaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgaccaagggcgggcccgggcacgaggagcccatccccatgagcacgtacggctggaacctcgtccggctgcagagcggggtggacgtgttcttcaccccgcccgagaagtgcgacaccctgctctgcgacatcggcgagtccagccccaaccccaccatcgaggccggccgcacgctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccaccgggaacatcgtctccagcgtgaacatgatctcccgcatgctgatcaaccggttcacgatgaagcacaagaaggcgacctacgagccggacgtggacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtcaacggggtggtgcgcctgctcaccaagccctgggacgtcgtgccgatggtgacgcagatggccatgaccgacaccacccccttcggccagcagcgggtcttcaaggagaaggtggacacgcgcacccaggagcccaaggagggcaccaagaagctgatgcggatcaccgccgagtggctgtggaaggagctcgggaagaagaagacgccccgcatgtgcacccgggaggagttcacccgcaaggtgcggagcaacgcggccctgggcgccatcttcaccgacgagaacaagtggaagtccgcccgcgaggccgtcgaggacagccggttctgggagctggtggaccgcgagcggaacctccacctggaggggaagtgcgagacgtgcgtctacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccggcgcaacagcctgtccggggtggagggcgaggggctgcacaagctcggctacatcctgcgggacgtgagcaagaaggagggcggggcgatgtacgccgacgacaccgccggctgggacacccgcatcaccctggaggacctcaagaacgaggagatggtcacgaaccacatgaagggggagcacaagaagctggccgaggccatcttcaagctgacctaccagaacaaggtggtgcgcgtccagcggccgacgccccggggcaccgtgatggacatcatctcccggaaggaccagcgcgggagcggccaggtgggcacgtacgggctcaacaccttcaccaacatggaggcgcagctgatccggcagatggagggcgaggggatcttcaagtccatccagcgcctgaccgtcacggaggagatcgccgtgcagaactggctcgcccgggtgggccgcgagcggctgagccgcatggccatctccggcgacgactgcgtcgtgaagcccctggacgaccggttcgccagcgcgctcaccgccctgaacgacatggggaaggtgcgcaaggacatccagcagtgggagccctcccggggctggaacgactggacccaggtcccgttctgcagccaccacttccacgagctggtgatgaaggacgggcgcgtgctcgtcgtgccctgccggaaccaggacgagctgatcggccgcgcccggatctcccagggggccggctggagcctgaaggagaccgcctgcctcggcaagtcctacgcgcagatgtggacgctgatgtacttccaccgccgggacctgcgcctcgccgccaacgccatctgcagcgccgtgccctcccactgggtccccaccagccgcaccacctggtccatccacgcgaagcacgagtggatgaccacggaggacatgctggccgtgtggaaccgggtgtggatccaggagaacccgtggatggaggacaagacccccgtcgagagctgggaggaggtgccctacctggggaagcgcgaggaccagtggtgcggcagcctcatcgggctgacctcccgggccacctgggccaagaacatccagacggcgatcaaccaggtgcgcagcctgatcggcaacgaggagtacaccgactacatgccctccatgaagcggttccgcaaggaggaggaggaggccggggtcctctggtga

SEQ ID NO: 9453 - RNA, 9876 nt, synthetic construct
  misc_feature 1..9876: note = derived and/or modified CDS sequence (opt1) from DENV-2__EU482731__SS-prME
  source 1..9876: mol_type = other RNA
accgccggcgtgatcgtcatgctgatccccaccgtgatggccttccacctcaccacccggaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccggaccgagacctggatgagctccgagggggcctggaagcacgtgcagcggatcgagacctggatcctgcgccacccgggcttcaccatcatggccgccatcctggcgtacaccatcgggaccacgcacttccagcgggccctcatcttcatcctgctgaccgccgtcgcccccagcatgaccatgcgctgcatcggcatctccaaccgggacttcgtggagggcgtgagcgggggctcctgggtcgacatcgtgctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcgggatcgtgacctgcgccatgttcacgtgcaagaagaacatggagggcaagatcgtgcagcccgagaacctggagtacaccatcgtcatcacgccccacagcggggaggagcacgcggtgggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgccaagaagcaggacgtcgtggtcctcgggtcccaggagggcgcgatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcaccgacctggagaagcggcacgtgctcgggcgcctgatcaccgtgaacccgatcgtcacggagaaggacgcccccgtgaacatcgaggcggagccgcccttcggcgacagctacatcatcgtgggggtcgagccgggccagctgaagctcaactggttcaagaaggggtccagcatcggccagatgttcgagaccaccatgcgcggcgccaagcggatggccatcctgggggacaccgcctgggacttcggctccctcggcggggtgttcacgagcatcgggaaggccctccaccaggtgttcggggcgatctacggcgccgccttctccggggtcagctggaccatgaagatcctgatcggcgtgatcatcacctggatcgggatgaactcccgcagcacctccctgagcgtgtccctggtcctcgtgggcgtggtcacgctgtacctgggggccatggtgcaggcggacagcggctgcgtggtctcctggaagaacaaggagctcaagtgcggcagcgggatcttcatcaccgacaacgtgcacacctggaccgagcagtacaagttccagcccgagtcccccagcaagctggccagcgccatccagaaggcccacgaggagggcatctgcgggatccggtccgtgacgcgcctggagaacctcatgtggaagcagatcacccccgagctgaaccacatcctgagcgagaacgaggtcaagctcaccatcatgaccggcgacatcaaggggatcatgcaggccggcaagcggtccctgcgcccgcagcccacggagctgaagtacagctggaagacctggggcaaggcgaagatgctctccaccgagagccacaaccagaccttcctgatcgacgggcccgagacggccgagtgcccgaacaccaaccgggcctggaactccctggaggtggaggactacggcttcggggtgttcaccaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacacgctgtggagcaacggcgtgctggagtccgagatgatcatccccaagaacttcgccgggcccgtgagccagcacaactaccgcccgggctaccacacccagaccgcggggccctggcacctcggcaagctggagatggacttcgacttctgcgaggggaccacggtggtcgtgaccgaggactgcggcaaccggggcccctccctgcgcaccaccacggccagcgggaagctcatcaccgagtggtgctgccggagctgcaccctgcccccgctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggccctgttcctcgaggagatgctgcggacgcgcgtgggcaccaagcacgcgaccctgctcgtcgccctgtccttcgtgaccctgatcacggggaacatgagcttccgggacctcggccgcgtgatggtcatggtgggggccaccatgaccgacgacatcggcatgggcgtgacctacctggccctgctcgccgcgttcaaggtccgccccacgttcgccgccgggctgctgctccggaagctgacctccaaggagctgatgatggccaccatcggcatcgccctcctgagccagtccaccctgcccgagacgatcctcgagctgaccgacgcgctggccctcgggatgatggtgctgaagatcgtgcgcaacatggagaagtaccagctggccgtcaccatcatggccatcagctgcgtgccgaacgccgtgatcctccagaacgcgtggaaggtctcctgcaccatcctggccgccgtgagcgtcagccccctgctcctgacgagctcccagcagaaggccgactggatccccctggcgctcaccatcaagggcctgaaccccaccgccatcttcctgaccacgctcagccggacctccaagaagcgcagctggccgctgaacgaggccatcatggccgtgggcatggtgtccatcctggccagctccctcctgaagaacgacatccccatgaccgggcccctggtcgcgggcgggctcctgaccgtgtgctacgtgctgacgggccggagcgccgacctcgagctggagcgcgccgccgacgtcaagtgggaggaccaggccgagatcagcgggtccagccccatcctgtccatcaccatcagcgaggacggctccatgagcatcaagaacgaggaggaggagcagaccctcaccatcctgatccggaccggcctgctcgtgatctccggggtgttcccggtcagcatccccatcacggcggccgcctggtacctgtgggaggtgaagaagcagcgcgccggcgtgctgtgggacgtccccagcccgccgcccgtggggaaggccgagctcgaggacggcgcgtaccggatcaagcagcgcgggatcctgggctacagccagatcggcgccggggtgtacaaggagggcaccttccacaccatgtggcacgtcacccgcggggccgtgctgatgcaccgcggcaagcggatcgagccctcctgggccgacgtgaagaaggacctcatcagctacgggggcggctggaagctggagggggagtggaaggagggcgaggaggtccaggtgctggccctcgagcccgggaagaacccccgcgcggtgcagacgaagcccggcatcttcaagaccaacaccgggaccatcggcgccgtctccctggacttcagccccggcacgtccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggccccgacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctcagccccgtgcgcgtcccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatcgacgaggagcgcgagatccccgagcggagctggaactccggccacgagtgggtgaccgacttcaaggggaagacggtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggccaacttcaaggcggagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccatcgacggggagtaccggctccgcggcgaggcccggaagacgttcgtggacctgatgcgccgcggggacctgcccgtctggctcgcctacaaggtggccgcggagggcatcaactacgccgaccgcaagtggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcaccgagatggggcggctccccacgttcatgacccagaaggcccgcaacgccctggacaacctggccgtgctccacaccgcggaggtcggcgggcgggcccacaaccacgccctgtccgagctgcccgagaccctcgagacgctgctgctcctgaccctgctcgccaccgtgaccggcggcatcttcctgttcctgatgagcgggaagggcatcgggaagatgaccctcggcatgtgctgcatcatcacggcctccatcctgctgtggtacgcgcagatccagccgcactggatcgccgccagcatcatcctcgagttcttcctgatcgtgctgctcatccccgagcccgagaagcagcgcacgccccaggacaaccagctgacctacgtcgtgatcgccatcctgaccgtggtcgccgcgacgatggccaacgagatggggttcctcgagaagaccaagaaggacctgggcttcggctccatcaccacccaggagagcgagagcaacatcctggacatcgacctccggccggcctccgcctggacgctgtacgccgtggcgaccaccttcgtgacccccatgctgcgccacagcatcgagaactccagcgtcaacgtgtccctcacggccatcgccaaccaggccaccgtgctgatggggctgggcaaggggtggcccctcagcaagatggacatcggcgtccccctgctggcgatcgggtgctactcccaggtgaacccgatcaccctcaccgccgccctgctgctcctggtggcccactacgccatcatcggccccggcctgcaggcgaaggccacgcgggaggcccagaagcgcgccgccgcggggatcatgaagaaccccaccgtcgacggcatcaccgtgatcgacctcgagcccatcccgtacgaccccaagttcgagaagcagctgggccaggtgatgctgctcatcctgtgcgtcacccaggtgctgatgatgcggacgacctgggccctctgcgaggccctgaccctggccaccggccccatcagcacgctctgggaggggaaccccggccgcttctggaacaccaccatcgccgtgtccatggcgaacatcttccgcggcagctacctggccggggccggcctcctgttctccatcatgaagaacaccacgaacacccggcgcgggaccggcaacgtcggcgagaccctgggggagaagtggaagtcccggctgaacgccctcggcaagtccgagttccagatctacaagaagtccgggatccaggaggtggaccgcacgctggcgaaggagggcatcaagcgcggggagaccgaccaccacgccgtgtcccgcggcagcgccaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgaccaagggcgggcccgggcacgaggagcccatccccatgagcacgtacggctggaacctcgtccggctgcagtccggggtggacgtgttcttcaccccgcccgagaagtgcgacaccctgctctgcgacatcggcgagagcagccccaaccccaccatcgaggccggccgcaccctgcgggtcctgaacctcgtggagaactggctgaacaacaacacgcagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgcgaccgggaacatcgtctccagcgtgaacatgatctcccggatgctgatcaaccgcttcacgatgaagcacaagaaggccacctacgagccggacgtggacctcggcagcgggacccggaacatcggcatcgagtccgagatccccaacctggacatcatcggcaagcgcatcgagaagatcaagcaggagcacgagaccagctggcactacgaccaggaccacccctacaagacgtgggcctaccacgggtcctacgagaccaagcagaccggcagcgcctccagcatggtcaacggggtggtgcgcctgctcaccaagccctgggacgtcgtgccgatggtgacgcagatggccatgaccgacaccacccccttcggccagcagcgggtcttcaaggagaaggtggacacgcgcacccaggagcccaaggagggcaccaagaagctgatgaagatcaccgcggagtggctgtggaaggagctcgggaagaagaagacgccccggatgtgcacccgcgaggagttcacccggaaggtgcgctccaacgccgccctgggcgccatcttcaccgacgagaacaagtggaagtccgcccgggaggcggtcgaggacgggcgcttctgggagctggtggaccgggagcgcaacctccacctggagggcaagtgcgagacgtgcgtctacaacatgatggggaagcgggagaagaagctgggcgagttcggcaaggccaaggggtcccgcgccatctggtacatgtggctcggcgcccggttcctggagttcgaggcgctggggttcctcaacgaggaccactggttcagccgcggcaactccctgagcggggtggagggcgagggcctgcaccggctcgggtacatcctgcgcgaggtgggcaagaaggagggcggcgccatgtacgccgacgacaccgccgggtgggacacccggatcaccctggaggacctcaagaacgaggagatggtcacgaaccacatgaagggcgagcacaagaagctggccgaggcgatcttcaagctgacctaccagaacaaggtggtgcgcgtccagcggccgacgccccggggcaccgtgatggacatcatcagccggaaggaccagcgcgggtccggccaggtggggacgtacggcctcaacaccttcaccaacatggaggcccagctgatccgccagatggagggcgaggggatcttcaagagcatccagcacctgaccgccacggaggagatcgccgtccagaactggctcgcccgggtgggccgcgagcggctgtcccgcatggcgatcagcggggacgactgcgtggtcaagcccatcgacgaccggttcgcctccgccctgaccgccctcaacgacatgggcaaggtgcgcaaggacatccagcagtgggagcccagccgggggtggaacgactggacccaggtgccgttctgctcccaccacttccacgagctggtcatgaaggacggccgcgtgctggtggtcccctgccggaaccaggacgagctcatcggccgcgcccggatcagccagggggcgggctggtccctgaaggagaccgcctgcctgggcaagagctacgcccagatgtggaccctcatgtacttccaccgccgggacctgcgcctggccgccaacgcgatctgctccgccgtgcccagccactgggtgcccacgtcccggaccacctggagcatccacgccaagcacgagtggatgaccacggaggacatgctcgccgtctggaaccgcgtgtggatccaggagaacccgtggatggaggacaagacccccgtggagtcctgggaggaggtcccctacctgggcaagcgggaggaccagtggtgcgggagcctgatcggcctcacctcccgcgcgacctgggccaagaacatccagacggccatcaaccaggtgcggagcctgatcggcaacgaggagtacaccgactacatgcccagcatgaagcgcttccgccgggaggaggaggaggccggggtgctgtggtga

SEQ ID NO: 9454 - RNA, 9876 nt, synthetic construct
  misc_feature 1..9876: note = derived and/or modified CDS sequence (opt1) from DENV-2__EU482732__SS-prME
  source 1..9876: mol_type = other RNA
accgtgggcgtcatcatcatgctgatccccaccgccatggccttccacctcaccacccgcaacggggagccccacatgatcgtgggccggcaggagaaggggaagtccctgctgttcaagaccgaggacggcgtgaacatgtgcaccctcatggcgatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgccatcctggcgtacaccatcgggaccacgcacttccagcgggccctcatcttcatcctgctgaccgccgtggcccccagcatgaccatgcgctgcatcggcatctccaaccgggacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgccatgttcacgtgcaagaagaacatggagggcaaggtggtgctgcccgagaacctggagtacaccatcgtcatcacgccccacagcggggaggagcacgcggtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgccaagaagcaggacgtcgtggtcctggggtcccaggagggcgcgatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagaccacgatgcgcggcgcgaagcggatggccatcctgggggacaccgcctgggacttcggcagcctcgggggcgccttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcgggccgccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcgcacgacctgggcgctctgcgaggccctgaccctggccaccggccccatcagcacgctctgggaggggaaccccggccggttctggaacaccaccatcgccgtgtccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacgtacggctggaacctcgtgcggctgcagagcggggtggacgtcttcttcaccccgcccgagaagtgcgacaccctgctctgcgacatcggcgagtccagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcacgatgaagcacaagaaggcgacctacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtcaagctgctcaccaagccctgggacgtggtgccgatggtcacgcagatggccatgaccgacaccacccccttcggccagcagcgcgtgttcaaggagaaggtggacacgcggacccaggagcccaaggagggcaccaagaagctgatgcgcatcaccgccgagtggctgtggaaggagctcgggaagaagaagacgccccggatgtgcacccgcgaggagttcacccggaaggtccgcagcaacgcggccctgggcgccatcttcaccgacgagaacaagtggaagtccgcccgggaggccgtggaggacagccgcttctgggagctggtcgaccgggagcgcaacctccacctggaggggaagtgcgagacgtgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtcagcaagaaggagggcggcgcgatgtacgccgacgacaccgccgggtgggacacccgcatcaccctggaggacctcaagaacgaggagatggtgacgaaccacatgaagggcgagcacaagaagctggccgaggccatcttcaagctgacctaccagaacaaggtggtccgggtgcagcgcccgacgccccgggggaccgtgatggacatcatctcccggaaggaccagcgcggcagcggccaggtcgggacgtacggcctcaacaccttcaccaacatggaggcgcagctgatccggcagatggagggggagggcatcttcaagtccatccagcgcctgaccgtgacggaggagatcgccgtgcagaactggctcgcccgggtcggccgcgagcggctgagccgcatggccatctccggggacgactgcgtggtgaagcccctggacgaccggttcgccagcgcgctcaccgccctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgccggctggagcctgaaggagaccgcctgcctcgggaagtcctacgcgcagatgtggacgctgatgtacttccaccgccgggacctgcgcctcgccgccaacgccatctgcagcgccgtcccctcccactgggtgcccaccagccggaccacctggtccatccacgcgaagcacgagtggatgaccacggaggacatgctggccgtgtggaaccgcgtctggatccaggagaacccgtggatggaggacaagacccccgtggagagctgggaggaggtgccctacctgggcaagcgcgaggaccagtggtgcgggagcctcatcggcctgacctcccgggccacctgggccaagaacatccagacggcgatcaaccaggtccgcagcctgatcgggaacgaggagtacaccgactacatgccctccatgaagcggttccgcaaggaggaggaggaggccggcgtgctctggtga

SEQ ID NO: 9455 - RNA, 9876 nt, synthetic construct
  misc_feature 1..9876: note = derived and/or modified CDS sequence (opt1) from DENV-2__EU482733__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcgggccgccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcgcacgacctgggcgctctgcgaggccctgaccctggccaccggccccatcagcacgctctgggaggggaaccccggccggttctggaacaccaccatcgccgtgtccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacgtacggctggaacctcgtgcggctgcagagcggggtggacgtcttcttcaccccgcccgagaagtgcgacaccctgctctgcgacatcggcgagtccagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcacgatgaagcacaagaaggcgacctacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtccgcctgctcaccaagccctgggacgtggtgccgatggtcacgcagatggccatgaccgacaccacccccttcggccagcagcgggtgttcaaggagaaggtggacacgcgcacccaggagcccaaggagggcaccaagaagctgatgcggatcaccgccgagtggctgtggaaggagctcgggaagaagaagacgccccgcatgtgcacccgggaggagttcacccgcaaggtccggagcaacgcggccctgggcgccatcttcaccgacgagaacaagtggaagtccgcccgcgaggccgtggaggacagccggttctgggagctggtcgaccgcgagcggaacctccacctggaggggaagtgcgagacgtgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtcagcaagaaggagggcggcgcgatgtacgccgacgacaccgccgggtgggacacccggatcaccctggaggacctcaagaacgaggagatggtgacgaaccacatgaagggcgagcacaagaagctggccgaggccatcttcaagctgacctaccagaacaaggtggtccgcgtgcagcgcccgacgccccgggggaccgtgatggacatcatctcccgcaaggaccagcggggcagcggccaggtcgggacgtacggcctcaacaccttcaccaacatggaggcgcagctgatccgccagatggagggggagggcatcttcaagtccatccagcggctgaccgtgacggaggagatcgccgtgcagaactggctcgcccgcgtcggccgggagcgcctgagccggatggccatctccggggacgactgcgtggtgaagcccctggacgaccgcttcgccagcgcgctcaccgccctgaacgacatgggcaaggtccggaaggacatccagcagtgggagccctcccgcgggtggaacgactggacccaggtgccgttctgcagccaccacttccacgagctggtgatgaaggacggccgggtcctcgtggtgccctgccgcaaccaggacgagctgatcgggcgggcccgcatctcccagggcgccggctggagcctgaaggagaccgcctgcctcgggaagtcctacgcgcagatgtggacgctgatgtacttccaccggcgcgacctgcggctcgccgccaacgccatctgcagcgccgtcccctcccactgggtgcccaccagccgcaccacctggtccatccacgcgaagcacgagtggatgaccacggaggacatgctggccgtgtggaaccgcgtctggatccaggagaacccgtggatggaggacaagacccccgtggagagctgggaggaggtgccctacctgggcaagcgggaggaccagtggtgcgggagcctcatcggcctgacctcccgcgccacctgggccaagaacatccagacggcgatcaaccaggtccggagcctgatcgggaacgaggagtacaccgactacatgccctccatgaagcgcttccggaaggaggaggaggaggccggcgtgctctggtga

SEQ ID NO: 9456 - RNA, 9876 nt, synthetic construct
  misc_feature 1..9876: note = derived and/or modified CDS sequence (opt1) from DENV-2__EU482734__SS-prME
  source 1..9876: mol_type = other RNA
accgccggcgtgatcgtcatgctgatccccaccgccatggcgttccacctcaccacccggaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcatgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcgggggcgtgttcacctccgtggggaaggccctccaccaggtcttcggcgcgatctacggcgccgccttcagcggggtgtcctggaccatgaagatcctgatcggcgtgatcatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtcgtggtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgtggccgtgagcttcgtcacgctgatcaccgggaacatgtccttccgggacctgggccgcgtgatggtgatggtcggggccaccatgaccgacgacatcggcatgggcgtgacgtacctcgccctgctggccgcgttcaaggtgcgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggccctgaagatcgtcaagaacatggagaagtaccagctcgccgtgaccatcatggccatctcctgcgtgccgaacgcggtcatcctgcagaacgcctggaaggtgagctgcacgatcctggccgccgtgtccgtcagccccctcctgctgacctccagccagcagaaggcggactggatccccctcgccctgaccatcaagggcctgaaccccaccgccatcttcctcacgaccctgtcccgcaccagcaagaagcggtcctggccgctgaacgaggccatcatggccgtgggcatggtcagcatcctcgcgtccagcctgctgaagaacgacatccccatgaccgggcccctcgtggccggcgggctgctgacggtgtgctacgtcctcaccggccgcagcgccgacctggagctggagcgggccgccgacgtgaagtgggaggaccaggcggagatctccgggagctcccccatcctcagcatcaccatctccgaggacggcagcatgtccatccgcaacgaggaggaggagcagaccctgacgatcctgatccggaccggcctcctggtgatcagcggggtcttcccggtgtccatccccgtgaccgccgccgcctggtacctgtgggaggtcaagaagcagcgcgccggcgtgctctgggacgtgcccagcccgccgcccgtcgggaaggcggagctggaggacggcgcctaccggatcaagcagcgcgggatcctgggctactcccagatcggcgccggggtgtacaaggagggcaccttccacaccatgtggcacgtgacgcgcggggccgtcctcatgcaccgcggcaagcggatcgagcccagctgggccgacgtgaagaaggacctggtgtcctacgggggcggctggaagctggagggggagtggaaggagggcgaggaggtccaggtgctcgcgctggagcccgggaagaacccccgcgccgtgcagaccaagcccggcatcttcaagaccaacaccgggacgatcggcgccgtcagcctggacttctcccccggcaccagcgggtcccccatcgtggaccggaagggcaaggtggtcgggctctacggcaacggcgtggtgacccgcagcggggcctacgtctccgcgatcgcccagaccgagaagtccatcgaggacaaccccgagatcgaggacgacatcttccggaagaagcgcctgacgatcatggacctgcaccccggcgccgggaagaccaagcggtacctccccgccatcgtgcgcgaggccatcaagcggggcctgcgcaccctgatcctggcgccgacccgcgtggtcgccgccgagatggaggaggccctccgggggctgcccatccgctaccagacgcccgccatccgggcggagcacaccggccgcgagatcgtggacctgatgtgccacgccaccttcaccatgcggctcctgagccccgtgcgcgtcccgaactacaacctgatcatcatggacgaggcccacttcacggaccccgcctccatcgccgcgcggggctacatcagcacccgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgacggacttcaaggggaagaccgtctggttcgtgccgtccatcaaggccggcaacgacatcgccgcctgcctccgcaagaacggcaagaaggtgatccagctgagccggaagaccttcgactccgagtacgtcaagacccgcgccaacgactgggacttcgtggtgacgaccgacatcagcgagatgggggcgaacttcaaggccgagcgggtcatcgacccccgccggtgcatgaagcccgtgatcctgaccgacggcgaggagcgcgtgatcctcgccgggcccatgccggtcacccactccagcgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacgcccgagggcatcatcccgtccatgttcgagcccgagcgcgagaaggtggacgccatcgacggggagtaccggctgcgcggcgaggcccggaagaccttcgtggacctgatgcgccgcggggacctccccgtctggctggcctacaaggtggcggccgagggcatcaactacgccgaccgccggtggtgcttcgacgggatcaagaacaaccagatcctggaggagaacgtggaggtcgagatctggaccaaggagggcgagcgcaagaagctcaagccgcggtggctggacgcccgcatctacagcgaccccctggcgctcaaggagttcaaggagttcgccgccggccggaagtccctgaccctgaacctcatcacggagatggggcgcctgcccaccttcatgacccagaaggcccggaacgccctggacaacctcgcggtgctgcacaccgccgaggccggcgggaaggcctacaaccacgccctgagcgagctccccgagacgctggagaccctgctcctgctgaccctcctggcgaccgtcacgggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcacggtggtggccgccaccatggccaacgagatggggttcctggagaagaccaagaaggacctgggcctcggcagcatcaccacgcaggagagcgagtccaacatcctggacatcgacctgcggccggccagcgcgtggaccctctacgccgtcgccaccaccttcgtgacgcccatgctgcgccactccatcgagaacagctccgtgaacgtcagcctgaccgccatcgcgaaccaggccaccgtgctcatggggctgggcaaggggtggcccctgtccaagatggacatcggcgtgcccctcctggccatcgggtgctacagccaggtcaacccgatcaccctgacggccgccctcctgctgctcgtggcgcactacgccatcatcggccccggcctgcaggccaaggccacccgggaggcccagaagcgcgcggccgccgggatcatgaagaaccccaccgtggacggcatcaccgtcatcgacctggagcccatcccgtacgaccccaagttcgagaagcagctcgggcaggtcatgctgctgatcctctgcgtgacgcaggtcctgatgatgcggaccacctgggccctgtgcgaggccctcaccctggcgacgggccccatctccaccctgtgggaggggaaccccggccgcttctggaacaccaccatcgccgtgagcatggccaacatcttccgcggctcctacctcgccggggcgggcctgctgttcagcatcatgaagaacacgaccaacacccggcgcgggaccggcaacatcggcgagacgctcggggagaagtggaagtcccggctgaacgccctgggcaagagcgagttccagatctacaagaagtccgggatccaggaggtggaccgcaccctcgccaaggagggcatcaagcgcggggagaccgaccaccacgccgtcagccgcggctccgccaagctgcggtggttcgtggagcgcaacatggtgaccccggagggcaaggtcgtggacctggggtgcggccgcgggggctggagctactactgcgggggcctcaagaacgtgcgcgaggtcaagggcctgacgaagggcggccccgggcacgaggagcccatcaccatgtccacctacggctggaacctggtgcggctccagagcggggtggacgtcttcttcacgccgcccgagaagtgcgacacgctgctgtgcgacatcggcgagagctcccccaaccccaccatcgaggcgggccgcaccctccgggtgctgaacctggtggagaactggctcaacaacaacacccagttctgcatcaaggtcctgaacccctacatgcccagcgtgatcgagaagatggagaccctgcagcgcaagtacgggggcgccctcgtgcggaaccccctgtcccgcaacagcacgcacgagatgtactgggtctccaacgccaccgggaacatcgtgagctccgtgaacatgatcagccggatgctgatcaaccgcttcaccatgaagcacaagaaggccacctacgagcccgacgtcgacctgggctccgggacgcggaacatcggcatcgagagcgagatcccgaacctcgacatcatcggcaagcgcatcgagaagatcaagcaggagcacgagacctcctggcactacgaccaggaccacccctacaagacctgggcctaccacgggagctacgagaccaagcagacgggctccgcgagctccatggtgaacggggtggtccgcctgctgaccaagccctgggacgtggtgcccatggtcacccagatggccatgaccgacacgaccccgttcggccagcagcgggtgttcaaggagaaggtggacacccgcacccaggagcccaaggagggcacgaagaagctcatgaagatcaccgccgagtggctgtggaaggagctggggaagaagaagacgccccggatgtgcacccgcgaggagttcacgcggaaggtccgcagcaacgccgccctcggcgcgatcttcaccgacgagaacaagtggaagtccgcccgggaggccgtggaggacgggcgcttctgggagctggtggaccgggagcgcaacctgcacctcgagggcaagtgcgagacctgcgtctacaacatgatggggaagcgggagaagaagctgggcgagttcggcaaggccaaggggagccgcgcgatctggtacatgtggctgggcgcccggttcctcgagttcgaggccctggggttcctgaacgaggaccactggttctcccgcggcaacagcctcagcggggtggagggcgagggcctgcaccggctggggtacatcctccgcgacgtctccaagaaggagggcggggccatgtacgccgacgacaccgcgggctgggacacgcggatcaccctggaggacctgaagaacgaggagatggtgaccaaccacatgaagggggagcacaagaagctcgccgaggccatcttcaagctgacctaccagaacaaggtggtccgcgtgcagcggcccacgccgcgcggcaccgtgatggacatcatcagccggcgcgaccagcgcggctccgggcaggtcggcacctacgggctgaacaccttcacgaacatggaggcccagctcatccggcagatggagggcgagggcatcttcaagagcatccagcacctgaccgtgaccgaggagatcgccgtgcagaactggctggcgcgcgtcgggcgggagcgcctctcccggatggccatcagcggcgacgactgcgtggtgaagcccatcgacgaccgcttcgcctccgccctgaccgccctgaacgacatggggaaggtccggaaggacatccagcagtgggagcccagccgcggctggaacgactggacccaggtgcccttctgctcccaccacttccacgagctcgtgatgaaggacgggcgggtcctggtggtgccgtgccgcaaccaggacgagctgatcggccgggcgcgcatcagccagggcgccgggtggtccctcaaggagaccgcctgcctgggcaagagctacgcccagatgtggaccctgatgtacttccaccggcgcgacctccggctggccgcgaacgccatctgctccgccgtccccagccactgggtgcccacctcccgcaccacgtggagcatccacgccaagcacgagtggatgaccaccgaggacatgctggcggtgtggaaccgggtctggatccaggagaacccctggatggaggacaagaccccggtggagtcctgggaggaggtgccctacctcgggaagcgcgaggaccagtggtgcggcagcctgatcgggctgacgagccgggccacctgggccaagaacatccagaccgccatcaaccaggtccgctccctcatcggcaacgaggagtacaccgactacatgcccagcatgaagcgcttccggcgcgaggaggaggaggccggcgtgctgtggtga

SEQ ID NO: 9457 - RNA, 9876 nt, synthetic construct
  misc_feature 1..9876: note = derived and/or modified CDS sequence (opt1) from DENV-2__EU482735__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcatgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcgggggcgtgttcacctccgtggggaaggccctccaccaggtcttcggcgcgatctacggcgccgccttcagcggggtgtcctggaccatgaagatcctgatcggcgtgatcatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtcgtggtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgtggccgtgagcttcgtcacgctgatcaccgggaacatgtccttccgggacctgggccgcgtgatggtgatggtcggggccaccatgaccgacgacatcggcatgggcgtgacgtacctcgccctgctggccgcgttcaaggtgcgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggccctgaagatcgtcaagaacatggagaagtaccagctcgccgtgaccatcatggccatctcctgcgtgccgaacgcggtcatcctgcagaacgcctggaaggtgagctgcacgatcctggccgccgtgtccgtcagccccctcctgctgacctccagccagcagaaggcggactggatccccctcgccctgaccatcaagggcctgaaccccaccgccatcttcctcacgaccctgtcccgcaccagcaagaagcggtcctggccgctgaacgaggccatcatggccgtgggcatggtcagcatcctcgcgtccagcctgctgaagaacgacatccccatgaccgggcccctcgtggccggcgggctgctgacggtgtgctacgtcctcaccggccgcagcgccgacctggagctggagcgggccgccgacgtgaagtgggaggaccaggcggagatctccgggagctcccccatcctcagcatcaccatctccgaggacggcagcatgtccatccgcaacgaggaggaggagcagaccctgacgatcctgatccggaccggcctcctggtgatcagcggggtcttcccggtgtccatccccgtgaccgccgccgcctggtacctgtgggaggtcaagaagcagcgcgccggcgtgctctgggacgtgcccagcccgccgcccgtcgggaaggcggagctggaggacggcgcctaccggatcaagcagcgcgggatcctgggctactcccagatcggcgccggggtgtacaaggagggcaccttccacaccatgtggcacgtgacgcgcggggccgtcctcatgcaccgcggcaagcggatcgagcccagctgggccgacgtgaagaaggacctggtgtcctacgggggcggctggaagctggagggggagtggaaggagggcgaggaggtccaggtgctcgcgctggagcccgggaagaacccccgcgccgtgcagaccaagcccggcatcttcaagaccaacaccgggacgatcggcgccgtcagcctggacttctcccccggcaccagcgggtcccccatcgtggaccggaagggcaaggtggtcgggctctacggcaacggcgtggtgacccgcagcggggcctacgtctccgcgatcgcccagaccgagaagtccatcgaggacaaccccgagatcgaggacgacatcttccggaagaagcgcctgacgatcatggacctgcaccccggcgccgggaagaccaagcggtacctccccgccatcgtgcgcgaggccatcaagcggggcctgcgcaccctgatcctggcgccgacccgcgtggtcgccgccgagatggaggaggccctccgggggctgcccatccgctaccagacgcccgccatccgggcggagcacaccggccgcgagatcgtggacctgatgtgccacgccaccttcaccatgcggctcctgagccccgtgcgcgtcccgaactacaacctgatcatcatggacgaggcccacttcacggaccccgcctccatcgccgcgcggggctacatcagcacccgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgacggacttcaaggggaagaccgtctggttcgtgccgtccatcaaggccggcaacgacatcgccgcctgcctccgcaagaacggcaagaaggtgatccagctgagccggaagaccttcgactccgagtacgtcaagacccgcgccaacgactgggacttcgtggtgacgaccgacatcagcgagatgggggcgaacttcaaggccgagcgggtcatcgacccccgccggtgcatgaagcccgtgatcctgaccgacggcgaggagcgcgtgatcctcgccgggcccatgccggtcacccactccagcgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacgcccgagggcatcatcccgtccatgttcgagcccgagcgcgagaaggtggacgccatcgacggggagtaccggctgcgcggcgaggcccggaagaccttcgtggacctgatgcgccgcggggacctccccgtctggctggcctacaaggtggcggccgagggcatcaactacgccgaccgccggtggtgcttcgacgggatcaagaacaaccagatcctggaggagaacgtggaggtcgagatctggaccaaggagggcgagcgcaagaagctcaagccgcggtggctggacgcccgcatctacagcgaccccctggcgctcaaggagttcaaggagttcgccgccggccggaagtccctgaccctgaacctcatcacggagatggggcgcctgcccaccttcatgacccagaaggcccggaacgccctggacaacctcgcggtgctgcacaccgccgaggccggcgggaaggcctacaaccacgccctgagcgagctccccgagacgctggagaccctgctcctgctgaccctcctggcgaccgtcacgggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcacggtggtggccgccaccatggccaacgagatggggttcctggagaagaccaagaaggacctgggcctcggcagcatcaccacgcaggagagcgagtccaacatcctggacatcgacctgcggccggccagcgcgtggaccctctacgccgtcgccaccaccttcgtgacgcccatgctgcgccactccatcgagaacagctccgtgaacgtcagcctgaccgccatcgcgaaccaggccaccgtgctcatggggctgggcaaggggtggcccctgtccaagatggacatcggcgtgcccctcctggccatcgggtgctacagccaggtcaacccgatcaccctgacggccgccctcctgctgctcgtggcgcactacgccatcatcggccccggcctgcaggccaaggccacccgggaggcccagaagcgcgcggccgccgggatcatgaagaaccccaccgtggacggcatcaccgtcatcgacctggagcccatcccgtacgaccccaagttcgagaagcagctcgggcaggtcatgctgctgatcctctgcgtgacgcaggtcctgaccatgcggaccacctgggccctgtgcgaggccctcacgctggcgaccggccccatctccaccctgtgggaggggaaccccggccgcttctggaacaccacgatcgccgtgagcatggccaacatcttccgcggctcctacctcgccggggcgggcctgctgttcagcatcatgaagaacaccaccaacacccggcgcgggacgggcaacatcggcgagaccctcggggagaagtggaagtcccggctgaacgccctgggcaagagcgagttccagatctacaagaagtccgggatccaggaggtggaccgcaccctcgccaaggagggcatcaagcgcggggagaccgaccaccacgccgtcagccgcggctccgccaagctgcggtggttcgtggagcgcaacatggtgacgccggagggcaaggtcgtggacctggggtgcggccgcgggggctggagctactactgcgggggcctcaagaacgtgcgcgaggtcaagggcctgaccaagggcggccccgggcacgaggagcccatccccatgtccacctacggctggaacctggtgcggctccagagcggggtggacgtcttcttcaccccgcccgagaagtgcgacacgctgctgtgcgacatcggcgagagctcccccaaccccaccatcgaggcgggccgcaccctccgggtgctgaacctggtggagaactggctcaacaacaacacccagttctgcatcaaggtcctgaacccgtacatgcccagcgtgatcgagaagatggagaccctgcagcgcaagtacgggggcgccctcgtgcggaaccccctgtcccgcaacagcacgcacgagatgtactgggtctccaacgccaccgggaacatcgtgagctccgtgaacatgatcagccggatgctgatcaaccgcttcaccatgaagcacaagaaggccacctacgagccggacgtcgacctgggctccgggacgcggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagaccaagcagacgggctccgcgagctccatggtgaacggggtggtccgcctgctgaccaagccctgggacgtggtgccgatggtcacccagatggccatgaccgacacgacccccttcggccagcagcgggtgttcaaggagaaggtggacacccgcacccaggagcccaaggagggcacgaagaagctcatgaagatcaccgccgagtggctgtggaaggagctggggaagaagaagacgccccggatgtgcacccgcgaggagttcacgcggaaggtccgcagcaacgccgccctcggcgcgatcttcaccgacgagaacaagtggaagtccgcccgggaggccgtggaggacgggcgcttctgggagctggtggaccgggagcgcaacctgcacctcgagggcaagtgcgagacctgcgtctacaacatgatggggaagcgggagaagaagctgggcgagttcggcaaggccaaggggagccgcgcgatctggtacatgtggctgggcgcccggttcctcgagttcgaggccctggggttcctgaacgaggaccactggttctcccgcggcaacagcctcagcggggtggagggcgagggcctgcaccggctggggtacatcctccgcgacgtctccaagaaggagggcggggccatgtacgccgacgacaccgcgggctgggacacgcggatcaccctggaggacctgaagaacgaggagatggtgaccaaccacatgaagggggagcacaagaagctcgccgaggccatcttcaagctgacctaccagaacaaggtggtccgcgtgcagcggccgacgccccgcggcaccgtgatggacatcatcagccggcgcgaccagcgcggctccgggcaggtcggcacctacgggctgaacaccttcacgaacatggaggcccagctcatccggcagatggagggcgagggcatcttcaagagcatccagcacctgaccgtgaccgaggagatcgccgtgcagaactggctggcgcgcgtcgggcgggagcgcctctcccggatggccatcagcggcgacgactgcgtggtgaagcccatcgacgaccgcttcgcctccgccctgaccgccctgaacgacatggggaaggtccggaaggacatccagcagtgggagcccagccgcggctggaacgactggacccaggtgccgttctgctcccaccacttccacgagctcgtgatgaaggacgggcgggtcctggtggtgccctgccgcaaccaggacgagctgatcggccgggcgcgcatcagccagggcgccgggtggtccctcaaggagaccgcctgcctgggcaagagctacgcccagatgtggaccctgatgtacttccaccggcgcgacctccggctggccgcgaacgccatctgctccgccgtccccagccactgggtgcccacctcccgcaccacgtggagcatccacgccaagcacgagtggatgaccaccgaggacatgctggcggtgtggaaccgggtctggatccaggagaacccgtggatggaggacaagacccccgtggagtcctgggaggaggtgccctacctcgggaagcgcgaggaccagtggtgcggcagcctgatcgggctgacgagccgggccacctgggccaagaacatccagaccgccatcaaccaggtccgctccctcatcggcaacgaggagtacaccgactacatgcccagcatgaagcgcttccggcgcgaggaggaggaggccggcgtgctgtggtga

SEQ ID NO: 9458 - RNA, 9876 nt, synthetic construct
  misc_feature 1..9876: note = derived and/or modified CDS sequence (opt1) from DENV-2__EU482736__SS-prME
  source 1..9876: mol_type = other RNA
accgcgggggtcatcatcatgctgatccccaccgcgatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccgcaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggtcgtgtccttcgtgaccctgatcacggggaacatgagcttccgggacctcggccgcgtcatggtgatggtgggggccaccatgaccgacgacatcggcatgggcatcacctacctggccctgctcgccgcgttcaaggtccgccccacgttcgccgccgggctgctgctccggaagctgacctccaaggagctgatgatggccaccatcggcatcgccctcctgagccagtccaccatccccgagacgatcctggagctcaccgacgcgctggccctgagcatgatggtgctcaagatcgtgcgcaacatggagaagtaccagctggccgtcaccatcatggccatctcctgcgtgccgaacgccgtgatcctgcagaacgcgtggaaggtcagctgcaccatcctcgccgccgtgtccgtcagccccctgctgctcacgtccagccagcagaaggccgactggatccccctggcgctgaccatcaaggggctcaaccccaccgccatcttcctgaccacgctgtcccggaccagcaagaagcgctcctggccgctcaacgaggccatcatggccgtgggcatggtgagcatcctggccagctccctgctcaagaacgacatccccatgaccggccccctggtcgccggcgggctgctcaccgtgtgctacgtgctgacggggcggagcgccgacctggagctcgagcgcgccgccgacgtcaagtgggaggaccaggccgagatctccgggagctcccccatcctgagcatcaccatctccgaggacgggagcatgtccatcaagaacgaggaggaggagcagaccctgaccatcctcatccggacgggcctgctggtgatcagcggcgtgttcccggtctccatccccatcaccgcggccgcctggtacctctgggaggtgaagaagcagcgcgccggggtgctgtgggacgtccccagcccgccgcccgtgggcaaggccgagctggaggacggggcgtaccggatcaagcagcgcggcatcctcgggtactcccagatcggcgccggcgtgtacaaggaggggaccttccacaccatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgcggtgcagacgaagcccggcctcttcaagaccaacaccggcaccatcggggccgtcagcctggacttctcccccggcacgagcggctcccccatcgtggaccggaaggggaaggtggtcggcctgtacgggaacggcgtggtgacccgcagcggcgcctacgtcagcgccatcgcgcagaccgagaagtccatcgaggacaaccccgagatcgaggacgacatcttccggaagaagcgcctcaccatcatggacctgcaccccggggccggcaagacgaagcggtacctgcccgccatcgtgcgcgaggccatcaagcgggggctgcgcaccctcatcctggccccgacccgcgtggtcgcggccgagatggaggaggccctgcggggcctccccatccgctaccagacccccgccatccgggccgagcacacggggcgcgagatcgtggacctgatgtgccacgcgaccttcaccatgcggctgctcagccccgtgcgcgtcccgaactacaacctgatcatcatggacgaggcccacttcaccgaccccgcctccatcgccgcccggggctacatcagcacgcgcgtggagatgggcgaggcggccgggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagacggtctggttcgtgccgtccatcaaggcggggaacgacatcgccgcctgcctgcgcaagaacggcaagaaggtgatccagctcagccggaagaccttcgactccgagtacgtcaagacccgcgccaacgactgggacttcgtggtgaccacggacatcagcgagatgggcgccaacttcaaggcggagcgggtcatcgacccccgccggtgcatgaagcccgtgatcctgaccgacggggaggagcgcgtgatcctggccggccccatgccggtcacccactccagcgccgcccagcggcgcgggcgcatcggccggaaccccaagaacgagaacgaccagtacatctacatgggggagcccctcgagaacgacgaggactgcgcccactggaaggaggcgaagatgctgctggacaacatcaacacccccgagggcatcatcccgtccatgttcgagcccgagcgcgagaaggtggacgccatcgacggcgagtaccggctccgcggggaggcccggaagacgttcgtggacctgatgcgccggggcgacctgcccgtctggctcgcctaccgcgtggccgcggaggggatcaactacgccgaccggcgctggtgcttcgacggcatcaagaacaaccagatcctggaggagaacgtggaggtcgagatctggaccaaggagggggagcggaagaagctgaagccgcgctggctcgacgcccggatctacagcgaccccctggccctgaaggagttcaaggagttcgcggccggccgcaagtccctcaccctgaacctgatcaccgagatgggccggctccccacgttcatgacccagaaggcccgcgacgccctggacaacctggccgtgctccacaccgcggaggccgggggccgggcctacaaccacgccctgagcgagctgcccgagaccctcgagacgctgctgctcctgaccctgctcgccaccgtcaccgggggcatcttcctgttcctgatgtccggcaaggggatcggcaagatgacgctcgggatgtgctgcatcatcaccgcgagcatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgccatcctgaccgtggtggcggccacgatggccaacgagatgggcttcctcgagaagaccaagaaggacctggggctgggctccatcgccacccaggagagcgagtccaacatcctcgacatcgacctgcggccggccagcgcgtggaccctgtacgccgtcgccacgaccttcgtgacccccatgctccgccactccatcgagaacagctccgtgaacgtcagcctgaccgccatcgcgaaccaggccacggtgctgatgggcctcgggaagggctggcccctgtccaagatggacatcggggtgcccctgctcgccatcggctgctacagccaggtcaacccgatcaccctgaccgccgccctgctcctgctggtggcgcactacgccatcatcgggcccggcctccaggccaaggccacccgggaggcccagaagcgcgcggccgccggcatcatgaagaaccccacggtggacgggatcaccgtcatcgacctggagcccatcccgtacgaccccaagttcgagaagcagctgggccaggtgatgctcctgatcctgtgcgtgacccaggtcctcatgatgcgcaccacgtgggccctgtgcgaggccctgaccctcgcgaccgggcccatctccaccctgtgggagggcaaccccgggcggttctggaacacgaccatcgccgtgagcatggccaacatcttccgcggctcctacctggccggcgcggggctcctgttcagcatcatgaagaacaccaccaacacgcggcgcggcaccgggaacatcggcgagaccctgggcgagaagtggaagtcccggctcaacgccctgggcaagagcgagttccagatctacaagaagtccggcatccaggaggtggaccgcaccctggccaaggaggggatcaagcggggcgagacggaccaccacgccgtcagccgcgggtccgccaagctccggtggttcgtggagcgcaacatggtgaccccggagggcaaggtcgtggacctgggctgcgggcggggcgggtggagctactactgcggcgggctgaagaacgtgcgcgaggtcaagggcctcaccaagggcgggcccggccacgaggagcccatccccatgagcacctacgggtggaacctggtgcggctgcagtccggcgtggacgtcttcttcacgccgcccgagaagtgcgacaccctcctgtgcgacatcggggagagctcccccaaccccaccatcgaggcgggccgcaccctgcgggtgctcaacctggtggagaactggctgaacaacaacacgcagttctgcatcaaggtcctcaacccgtacatgcccagcgtgatcgagaagatggagaccctgcagcgcaagtacggcggggccctggtgcggaaccccctgtcccgcaacagcacccacgagatgtactgggtctccaacgccaccggcaacatcgtgagctccgtgaacatgatcagccggatgctcatcaaccgcttcaccatgaagcacaagaaggccacgtacgagccggacgtcgacctggggtccggcacccgcaacatcgggatcgagagcgagatccccaacctggacatcatcggcaagcggatcgagaagatcaagcaggagcacgagacctcctggcactacgaccaggaccacccctacaagacctgggcctaccacggcagctacgagacgaagcagaccgggtccgcgagctccatggtgaacggcgtggtccgcctcctgaccaagccctgggacgtggtgccgatggtcacccagatggccatgacggacaccacccccttcgggcagcagcgggtgttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtccgcagcaacgccgccctgggggcgatcttcaccgacgagaacaagtggaagtccgcccgggaggccgtggaggacagccgcttctgggagctcatcgaccgggagcgcaacctgcacctggagggcaagtgcgagacctgcgtgtacaacatgatggggaagcgggagaagaagctcggcgagttcgggaaggccaagggcagccgcgcgatctggtacatgtggctgggcgcccggttcctggagttcgaggccctcgggttcctgaacgaggaccactggttctcccgcggcaacagcctgtccggggtcgagggcgaggggctccaccggctgggctacatcctgcgcgacgtgagcaagaaggagggcggggccatgtacgccgacgacacggcgggctgggacacccggatcaccctcgaggacctgaagaacgaggagatggtcaccaaccacatgaagggggagcacaagaagctggccgaggccatcttcaagctcacgtaccagaacaaggtggtgcgcgtccagcggccgacgccccgcggcaccgtgatggacatcatctcccgccgggaccagcgcgggagcggccaggtgggcacctacgggctgaacacgttcaccaacatggaggcccagctgatccggcagatggagggcgaggggatcttcaagtccatccagcacctcaccgtcaccgaggagatcgccgtgcagaactggctggcgcgcgtgggccgggagcgcctgagccggatggccatctccggcgacgactgcgtcgtgaagcccctcgacgaccgcttcgccagcgccctgacggccctgaacgacatggggaaggtgcggaaggacatccagcagtgggagccctcccgcggctggaacgactggacccaggtcccgttctgcagccaccacttccacgagctcgtgatgaaggacgggcgggtgctggtcgtgccctgccgcaaccaggacgagctgatcggccgggcgcgcatctcccagggggccggctggagcctcaaggagaccgcctgcctgggcaagtcctacgcccagatgtggaccctgatgtacttccaccggcgcgacctccggctggccgcgaacgccatctgcagcgccgtgccctcccactgggtccccacgagccgcaccacctggagcatccacgccaagcacgagtggatgaccaccgaggacatgctggcggtgtggaaccgggtgtggatccaggagaacccgtggatggaggacaagacgcccgtcgagtcctgggaggaggtgccctacctcgggaagcgcgaggaccagtggtgcggcagcctgatcgggctgacctcccgcgccacctgggccaagaacatccagaccgccatcaaccaggtgcggagcctcatcggcaacgaggagtacacggactacatgccctccatgaagcgcttccggcgcgaggaggaggaggccggggtcctgtggtga

SEQ ID NO: 9459 - RNA, 9876 nt, synthetic construct
  misc_feature 1..9876: note = derived and/or modified CDS sequence (opt1) from DENV-2__EU482737__SS-prME
  source 1..9876: mol_type = other RNA
accgcgggggtgatcgtgatgctgatccccaccgcgatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtcgaccggggctgggggaacggctgcggcctcttcggcaagggcgggatcgtgacctgcgcgatgttcacgtgcaagaagaacatggagggcaaggtggtcctgcccgagaacctggagtacaccatcgtgatcacgccccacagcggggaggagcacgccgtgggcaacgacaccgggaagcacggcaaggagatcaagatcaccccgcagtccagcatcaccgaggccgagctcaccgggtacggcacggtcaccatggagtgcagcccccgcaccggcctggacttcaacgagatggtgctgctccagatggaggacaaggcctggctggtgcaccggcagtggttcctggacctccccctgccctggctgccgggggccgacacccagggcagcaactggatccagaaggagacgctcgtcaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctcgagaagcggcacgtgctggggcgcctgatcaccgtcaacccgatcgtggcggagaaggacagccccgtgaacatcgaggccgagccgcccttcggcgactcctacatcatcatcggggtcgagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtgttcggcgccatctacggcgccgccttcagcggggtctcctggaccatgaagatcctgatcggcgtgatcatcacctggatcgggatgaacagccgctccacgagcctgtccgtgagcctcgtcctggtgggcgtggtcaccctgtacctcggggcgatggtgcaggccgactccggctgcgtggtcagctggaagtccaaggagctgaagtgcggcagcgggatcttcatcaccgacaacgtgcacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtcaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtggaggactacggcttcggggtgttcaccacgaacatctggctgaagctgcgcgagaagcaggacgtcttctgcgacagcaagctcatgtccgccgcgatcaaggacaaccgggccgtgcacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtcgtgaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtcacggccgggcacggccagatcgacaacttcagcctgggcgtgctggggatggccctcttcctggaggagatgctgcggacccgcgtgggcaccaagcacgccatgctcctggtcgtggtgtccttcgtcaccctgatcacggggaacatgagcttccgggacctcggccgcgtgatggtgatggtcggggccaccatgaccgacgacatcggcatgggcatcacctacctggccctgctcgccgcgttcaaggtgcgccccacgttcgccgccgggctgctgctccggaagctgacctccaaggagctgatgatggccaccatcggcatcgccctcctgagccagtccaccatccccgagacgatcctggagctcaccgacgcgctggccctgagcatgatggtgctcaagatcgtccgcaacatggagaagtaccagctggccgtgaccatcatggccatctcctgcgtgccgaacgccgtcatcctgcagaacgcgtggaaggtgagctgcaccatcctcgccgccgtctccgtgagccccctgctgctcacgtccagccagcagaaggccgactggatccccctggcgctgaccatcaaggggctcaaccccaccgccatcttcctgaccacgctgtcccggaccagcaagaagcgctcctggccgctcaacgaggccatcatggccgtgggcatggtcagcatcctggccagctccctgctcaagaacgacatccccatgaccggccccctggtggccggcgggctgctcaccgtgtgctacgtcctgacggggcggagcgccgacctggagctcgagcgcgccgccgacgtgaagtgggaggaccaggccgagatctccgggagctcccccatcctgagcatcaccatctccgaggacgggagcatgtccatcaagaacgaggaggaggagcagaccctgaccatcctcatccggacgggcctgctggtgatcagcggcgtcttcccggtgtccatccccatcaccgcggccgcctggtacctctgggaggtgaagaagcagcgcgccggggtcctgtgggacgtgcccagcccgccgcccgtgggcaaggccgagctggaggacggggcgtaccggatcaagcagcgcggcatcctcgggtactcccagatcggcgccggcgtctacaaggaggggaccttccacaccatgtggcacgtgacccggggcgccgtgctgatgcaccgcgggaagcggatcgagcccagctgggccgacgtcaagaaggacctgatctcctacggcgggggctggaagctcgagggcgagtggaaggagggggaggaggtccaggtgctggccctggagcccggcaagaacccccgcgcggtccagacgaagcccggcctcttcaagaccaacaccggcaccatcggggccgtgagcctggacttctcccccggcacgagcggctcccccatcgtggaccggaaggggaaggtcgtgggcctgtacgggaacggcgtggtcacccgcagcggcgcctacgtgagcgccatcgcgcagaccgagaagtccatcgaggacaaccccgagatcgaggacgacatcttccggaagaagcgcctcaccatcatggacctgcaccccggggccggcaagacgaagcggtacctgcccgccatcgtgcgcgaggccatcaagcgggggctgcgcaccctcatcctggccccgacccgcgtcgtggcggccgagatggaggaggccctgcggggcctccccatccgctaccagacccccgccatccgggccgagcacacggggcgcgagatcgtggacctgatgtgccacgcgaccttcaccatgcggctgctcagccccgtccgcgtgccgaactacaacctgatcatcatggacgaggcccacttcaccgaccccgcctccatcgccgcccggggctacatcagcacgcgcgtggagatgggcgaggcggccgggatcttcatgaccgccacgccgcccggctcccgggacccgttcccccagagcaacgcccccatcatggacgaggagcgcgagatccccgagcggtcctggaacagcgggcacgagtgggtcaccgacttcaagggcaagacggtgtggttcgtgccgtccatcaaggcggggaacgacatcgccgcctgcctgcgcaagaacggcaagaaggtcatccagctcagccggaagaccttcgactccgagtacgtgaagacccgcgccaacgactgggacttcgtggtcaccacggacatcagcgagatgggcgccaacttcaaggcggagcgggtgatcgacccccgccggtgcatgaagcccgtgatcctgaccgacggggaggagcgcgtcatcctggccggccccatgccggtgacccactccagcgccgcccagcggcgcgggcgcatcggccggaaccccaagaacgagaacgaccagtacatctacatgggggagcccctcgagaacgacgaggactgcgcccactggaaggaggcgaagatgctgctggacaacatcaacacccccgagggcatcatcccgtccatgttcgagcccgagcgcgagaaggtggacgccatcgacggcgagtaccggctccgcggggaggcccggaagacgttcgtcgacctgatgcgccggggcgacctgcccgtgtggctcgcctaccgcgtggccgcggaggggatcaactacgccgaccggcgctggtgcttcgacggcatcaagaacaaccagatcctggaggagaacgtcgaggtggagatctggaccaaggagggggagcggaagaagctgaagccgcgctggctcgacgcccggatctacagcgaccccctggccctgaaggagttcaaggagttcgcggccggccgcaagtccctcaccctgaacctgatcaccgagatgggccggctccccacgttcatgacccagaaggcccgcgacgccctggacaacctggccgtcctccacaccgcggaggccgggggccgggcctacaaccacgccctgagcgagctgcccgagaccctcgagacgctgctgctcctgaccctgctcgccaccgtgaccgggggcatcttcctgttcctgatgtccggcaaggggatcggcaagatgacgctcgggatgtgctgcatcatcaccgcgagcatcctgctgtggtacgcccagatccagccgcactggatcgccgccagcatcatcctcgagttcttcctgatcgtgctgctcatccccgagcccgagaagcagcgcacgccccaggacaaccagctgacctacgtcgtgatcgccatcctgaccgtggtcgcggccacgatggccaacgagatgggcttcctcgagaagaccaagaaggacctggggctgggctccatcgccacccaggagagcgagtccaacatcctcgacatcgacctgcggccggccagcgcgtggaccctgtacgccgtggccacgaccttcgtgacccccatgctccgccactccatcgagaacagctccgtcaacgtgagcctgaccgccatcgcgaaccaggccacggtgctgatgggcctcgggaagggctggcccctgtccaagatggacatcggggtccccctgctcgccatcggctgctacagccaggtgaacccgatcaccctgaccgccgccctgctcctgctggtggcgcactacgccatcatcgggcccggcctccaggccaaggccacccgggaggcccagaagcgcgcggccgccggcatcatgaagaaccccacggtcgacgggatcaccgtgatcgacctggagcccatcccgtacgaccccaagttcgagaagcagctgggccaggtgatgctcctgatcctgtgcgtcacccaggtgctcatgatgcgcaccacgtgggccctgtgcgaggccctgaccctcgcgaccgggcccatctccaccctgtgggagggcaaccccgggcggttctggaacacgaccatcgccgtgagcatggccaacatcttccgcggctcctacctggccggcgcggggctcctgttcagcatcatgaagaacaccaccaacacgcggcgcggcaccgggaacatcggcgagaccctgggcgagaagtggaagtcccggctcaacgccctgggcaagagcgagttccagatctacaagaagtccggcatccaggaggtcgaccgcaccctggccaaggaggggatcaagcggggcgagacggaccaccacgccgtgagccgcgggtccgccaagctccggtggttcgtggagcgcaacatggtcaccccggagggcaaggtggtggacctgggctgcgggcggggcgggtggagctactactgcggcgggctgaagaacgtccgcgaggtgaagggcctcaccaagggcgggcccggccacgaggagcccatccccatgagcacctacgggtggaacctggtgcggctgcagtccggcgtcgacgtgttcttcacgccgcccgagaagtgcgacaccctcctgtgcgacatcggggagagctcccccaaccccaccatcgaggcgggccgcaccctgcgggtgctcaacctggtcgagaactggctgaacaacaacacgcagttctgcatcaaggtgctcaacccgtacatgcccagcgtgatcgagaagatggagaccctgcagcgcaagtacggcggggccctggtccggaaccccctgtcccgcaacagcacccacgagatgtactgggtgtccaacgccaccggcaacatcgtgagctccgtcaacatgatcagccggatgctcatcaaccgcttcaccatgaagcacaagaaggccacgtacgagccggacgtggacctggggtccggcacccgcaacatcgggatcgagagcgagatccccaacctggacatcatcggcaagcggatcgagaagatcaagcaggagcacgagacctcctggcactacgaccaggaccacccctacaagacctgggcctaccacggcagctacgagacgaagcagaccgggtccgcgagctccatggtgaacggcgtcgtgcgcctcctgaccaagccctgggacgtggtcccgatggtgacccagatggccatgacggacaccacccccttcgggcagcagcgggtgttcaaggagaaggtcgacacccgcacgcaggagcccaaggagggcaccaagaagctgatgaagatcaccgccgagtggctctggaaggagctgggcaagaagaagacgccccggatgtgcacgcgcgaggagttcacccggaaggtgcgcagcaacgccgccctgggggcgatcttcaccgacgagaacaagtggaagtccgcccgggaggccgtggaggacagccgcttctgggagctcatcgaccgggagcgcaacctgcacctggagggcaagtgcgagacctgcgtctacaacatgatggggaagcgggagaagaagctcggcgagttcgggaaggccaagggcagccgcgcgatctggtacatgtggctgggcgcccggttcctggagttcgaggccctcgggttcctgaacgaggaccactggttctcccgcggcaacagcctgtccggggtggagggcgaggggctccaccggctgggctacatcctgcgcgacgtcagcaagaaggagggcggggccatgtacgccgacgacacggcgggctgggacacccggatcaccctcgaggacctgaagaacgaggagatggtgaccaaccacatgaagggggagcacaagaagctggccgaggccatcttcaagctcacgtaccagaacaaggtggtccgcgtgcagcggccgacgccccgcggcaccgtgatggacatcatctcccgccgggaccagcgcgggagcggccaggtcggcacctacgggctgaacacgttcaccaacatggaggcccagctgatccggcagatggagggcgaggggatcttcaagtccatccagcacctcaccgtgaccgaggagatcgccgtgcagaactggctggcgcgcgtcggccgggagcgcctgagccggatggccatctccggcgacgactgcgtggtgaagcccctcgacgaccgcttcgccagcgccctgacggccctgaacgacatggggaaggtccggaaggacatccagcagtgggagccctcccgcggctggaacgactggacccaggtgccgttctgcagccaccacttccacgagctcgtgatgaaggacgggcgggtcctggtggtgccctgccgcaaccaggacgagctgatcggccgggcgcgcatctcccagggggccggctggagcctcaaggagaccgcctgcctgggcaagtcctacgcccagatgtggaccctgatgtacttccaccggcgcgacctccggctggccgcgaacgccatctgcagcgccgtcccctcccactgggtgcccacgagccgcaccacctggagcatccacgccaagcacgagtggatgaccaccgaggacatgctggcggtgtggaaccgggtctggatccaggagaacccgtggatggaggacaagacgcccgtggagtcctgggaggaggtgccctacctcgggaagcgcgaggaccagtggtgcggcagcctgatcgggctgacctcccgcgccacctgggccaagaacatccagaccgccatcaaccaggtccggagcctcatcggcaacgaggagtacacggactacatgccctccatgaagcgcttccggcgcgaggaggaggaggccggggtgctgtggtga

SEQ ID NO: 9460 - RNA, 9876 nt, synthetic construct
  misc_feature 1..9876: note = derived and/or modified CDS sequence (opt1) from DENV-2__EU482739__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacctggagaagtaccagctggccgtcaccatcatggccatcagctgcgtgccgaacgccgtgatcctccagaacgcctggaaggtctcctgcaccatcctggcggccgtgagcgtcagccccctgctcctgacgagctcccagcagaaggccgactggatccccctggccctcaccatcaagggcctgaaccccaccgcgatcttcctgaccacgctcagccggacctccaagaagcgcagctggccgctgaacgaggccgtgatggccgtgggcatggtctccatcctggccagcagcctcctgaagaacgacatccccatgaccgggcccctggtggccggcgggctcctgaccgtgtgctacgtcctgacgggccggtccgcggacctcgagctggagcgcgccgccgacgtgaagtgggaggaccaggccgagatcagcgggtccagccccatcctgtccatcaccatcagcgaggacggctccatgagcatcaagaacgaggaggaggagcagaccctcaccatcctgatccggacgggcctgctcgtgatctccggggtcttcccggtgagcatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctacagccagatcggcgcgggggtctacaaggagggcaccttccacaccatgtggcacgtgacccgcggggccgtgctgatgcaccgcggcaagcggatcgagccctcctgggccgacgtcaagaaggacctgatcagctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgtccctggacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctctcccccgtccgcgtgccgaactacaacctgatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctctcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctgaccgacggcgaggagcgggtcatcctggcggggcccatgccggtgacccacagctccgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctactccgaccccctggccctgaaggagttcaaggagttcgccgcgggccggaagtccctcaccctgaacctgatcaccgagatggggcgcctccccacgttcatgacccagaaggcccgggacgccctggacaacctggccgtcctccacaccgccgaggtgggcgggcgcgcgtacaaccacgccctgtccgagctgcccgagaccctcgagacgctgctgctcctgaccctgctcgccaccgtgaccggcggcatcttcctgttcctgatgagcgggaagggcatcgggaagatgacgctcggcatgtgctgcatcatcaccgcctccatcctgctgtggtacgcccagatccagccgcactggatcgcggccagcatcatcctcgagttcttcctgatcgtcctgctcatccccgagcccgagaagcagcggacgccccaggacaaccagctgacctacgtggtgatcgccatcctgaccgtcgtggccgccacgatggcgaacgagatggggttcctcgagaagaccaagaaggacctgggcctgggcagcatcaccacccaggagtccgagagcaacatcctcgacatcgacctgcgcccggcctccgcctggacgctgtacgccgtggccaccaccttcgtcacccccatgctccggcacagcatcgagaactccagcgtgaacgtgtccctgacggcgatcgccaaccaggccaccgtcctgatggggctcggccgcgggtggcccctgagcaagatggacatcggcgtgcccctgctcgccatcgggtgctactcccaggtgaacccgatcaccctgaccgcggccctgctcctgctggtcgcccactacgccatcatcggccccggcctccaggccaaggcgacgcgcgaggcccagaagcgggccgccgccgggatcatgaagaaccccaccgtggacggcatcaccgtgatcgacctggagcccatcccgtacgaccccaagttcgagaagcagctggggcaggtcatgctcctggtgctgtgcgtgacccaggtcctcatgatgcgcacgacctgggcgctgtgcgaggccctgaccctcgccaccggccccatcagcacgctgtgggaggggaaccccggccggttctggaacaccaccatcgccgtgtccatggccaacatcttccgcggcagctacctggcgggggccggcctcctgttctccatcatgaagaacaccacgaacacccggcgcgggaccggcaacatcggcgagaccctgggggagaagtggaagtcccggctcaacgccctgggcaagtccgagttccagacgtacaagaagtccgggatccaggaggtggaccgcaccctggccaaggagggcatcaagcgcggggagaccgaccaccacgcggtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcacgaagggcgggcccgggcacgaggagcccatccccatgagcacctacggctggaacctggtgcggctgcagagcggggtggacgtcttcttcaccccgcccgagaagtgcgacaccctcctgtgcgacatcggcgagtccagccccaaccccacgatcgaggccggccgcaccctgcgggtgctcaacctggtggagaactggctgaacaacaacacccagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgccacggggaacatcgtgtccagcgtgaacatgatctcccgcatgctcatcaaccggttcaccatgaagcacaagaaggcgacctacgagccggacgtcgacctgggcagcgggacccgcaacatcggcatcgagaacgagatccccaacctggacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtggtccgcctcctgacgaagccctgggacgtggtgccgatggtcacccagatggccatgaccgacaccacgcccttcggccagcagcgggtgttcaaggagaaggtggacacccgcacccaggagcccaaggagggcaccaagaagctgatgcggatcacggccgagtggctctggaaggagctggggaagaagaagacgccccggatgtgcacccgggaggagttcacccgcaaggtccggagcaacgcggccctgggcgccatcttcacggacgagaacaagtggaagtccgcccgcgaggccgtggaggacagccggttctgggagctcgtcgaccgcgagcggaacctgcacctggaggggaagtgcgagacctgcgtgtacaacatgatgggcaagcgcgagaagaagctcggggagttcggcaaggcgaagggctcccgggccatctggtacatgtggctgggggcccgcttcctggagttcgaggccctcggcttcctgaacgaggaccactggttcagccgggggaacagcctgtccggcgtggagggggagggcctccacaagctgggctacatcctgcgcgacgtcagcaagaaggagggcggcgcgatgtacgccgacgacaccgccgggtgggacacccggatcacgctcgaggacctgaagaacgaggagatggtgaccaaccacatgaagggcgagcacaagaagctggccgaggccatcttcaagctcacctaccagaacaaggtggtccgcgtgcagcgcccgacgccccgggggacggtgatggacatcatctcccgcaaggaccagcggggcagcggccaggtcgggacctacggcctgaacaccttcaccaacatggaggcgcagctgatccgccagatggagggggagggcatcttcaagtccatccagcacctcacggtgaccgaggagatcgccgtgcagaactggctggcccgggtcggccgcgagcggctgagccgcatggccatctccggggacgactgcgtggtgaagcccctcgacgaccggttcgccagcgcgctgaccgccctgaacgacatgggcaaggtccgcaaggacatccagcagtgggagccctcccgggggtggaacgactggacccaggtgccgttctgcagccaccacttccacgagctcgtgatgaaggacggccgcgtcctggtggtgccctgccggaaccaggacgagctgatcgggcgcgcccggatctcccagggcgccggctggagcctcaaggagacggcctgcctggggaagtcctacgcgcagatgtggaccctgatgtacttccaccgccgggacctccgcctggccgccaacgccatctgcagcgccgtcccctcccactgggtgcccaccagccggaccacctggtccatccacgcgaagcacgagtggatgacgaccgaggacatgctggccgtgtggaaccgcgtctggatccaggagaacccgtggatggaggacaagacccccgtggagagctgggaggaggtgccctacctcggcaagcgcgaggaccagtggtgcgggagcctgatcggcctgacctcccgggccacgtgggccaagaacatccagaccgcgatcaaccaggtccgcagcctcatcgggaacgaggagtacaccgactacatgccctccatgaagcggttccgcaaggaggaggaggaggccggcgtgctgtggtga

SEQ ID NO: 9461 - RNA, 9876 nt, synthetic construct
  misc_feature 1..9876: note = derived and/or modified CDS sequence (opt1) from DENV-2__EU482740__SS-prME
  source 1..9876: mol_type = other RNA
accgccggggtgatcatcatgctgatccccaccgccatggcgttccacctcaccacccgcaacggggagccccacatgatcgtcgggcggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagtccaaggagctgaagtgcggcagcgggatcttcatcaccgacaacgtccacacgtggaccgagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgacgatcatgaccggcgacatcaaggggatcatgcagccgggcaagcggtccctgcgcccccagcccaccgagctcaagtacagctggaagacctggggcaaggccaagatgctgtccacggagagccacaaccagaccttcctgatcgacgggccggagaccgcggagtgccccaacaccaaccgggcctggaactccctcgaggtcgaggactacggcttcggggtgttcacgaccaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggccggtgagccagcacaactaccgccccggctaccacacccagacggccgggccctggcacctgggcaagctggagatggacttcgacttctgcgaggggaccaccgtggtggtcaccgaggactgcggcaaccggggccccagcctccgcacgaccaccgcgtccgggaagctgatcaccgagtggtgctgccggagctgcacgctgccgcccctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacccgcgtgggcaccaagcacgccatcctcctggtggcggtctccttcgtgacgctgatcaccgggaacatgagcttccgggacctcggccgcgtgatggtcatggtgggggccaccatgaccgacgacatcggcatgggcgtgacgtacctggccctgctcgccgccttcaaggtccgccccaccttcgcggccgggctgctgctccggaagctgacctccaaggagctgatgatggccaccatcggcatcgccctcctgagccagtccacgatcccggagaccatcctggagctcaccgacgccctggcgctggggatgatggtgctcaagatcgtgcgcaacatggagaagtaccagctggccgtcaccatcatggccatcagctgcgtgcccaacgccgtgatcctgcagaacgcctggaaggtctcctgcacgatcctcgcggtggtcagcgtgagccccctgctgctcaccagctcccagcagaaggccgactggatccccctggccctgaccatcaagggcctcaacccgaccgccatcttcctgacgaccctgagccggacctccaagaagcgcagctggcccctcaacgaggcgatcatggccgtgggcatggtctccatcctggccagcagcctgctcaagaacgacatccccatgaccgggcccctggtggccggcgggctgctcacggtgtgctacgtcctgaccggccggtccgccgacctggagctcgagcgcgcggccgacgtgaagtgggaggaccaggccgagatcagcgggtccagcccgatcctgtccatcaccatcagcgaggacggctccatgagcatcaagaacgaggaggaggagcagaccctgacgatcctcatccggaccggcctgctggtgatctccggggtcttccccgtgagcatccccatcaccgccgccgcgtggtacctctgggaggtgaagaagcagcgcgccggcgtcctgtgggacgtgccctccccgccgcccgtggggaaggccgagctggaggacggcgcctaccggatcaagcagcgcgggatcctcggctacagccagatcggcgccggggtctacaaggagggcaccttccacaccatgtggcacgtgacgcgcggggcggtgctgatgcaccgcggcaagcggatcgagccgtcctgggccgacgtcaagaaggacctgatcagctacgggggcggctggaagctcgagggggagtggaaggagggcgaggaggtccaggtgctggccctggagcccgggaagaacccccgcgccgtccagaccaagcccggcctcttcaagaccaacaccgggacgatcggcgccgtgtccctggacttcagcccgggcacctccgggagccccatcgtggaccggaagggcaaggtcgtggggctgtacggcaacggcgtggtcacccgctccggggcgtacgtgagcgccatcgcccagaccgagaagtccatcgaggacaaccccgagatcgaggacgacatcttccggaagaagcgcctcacgatcatggacctgcaccccggcgccgggaagaccaagcggtacctgccggcgatcgtgcgcgaggccatcaagcggggcctgcgcaccctcatcctggcccccacccgcgtcgtggccgccgagatggaggaggcgctgcgggggctccccatccgctaccagacgcccgccatccgggccgagcacaccggccgcgagatcgtggacctgatgtgccacgccaccttcaccatgcggctgctctccccggtccgcgtgcccaactacaacctgatcatcatggacgaggcccacttcacggaccccgcgagcatcgccgcccggggctacatctccacccgcgtggagatgggggaggccgccggcatcttcatgaccgcgacgccgcccgggagccgggaccccttcccccagtccaacgcccccatcatggacgaggagcgcgagatccccgagcggagctggaactccggccacgagtgggtcacggacttcaaggggaagaccgtgtggttcgtgcccagcatcaaggccggcaacgacatcgccgcgtgcctgcgcaagaacggcaagcgggtcatccagctctcccgcaagaccttcgacagcgagtacgtgaagacccgggccaacgactgggacttcgtggtcacgaccgacatctccgagatgggggccaacttcaaggccgagcgcgtgatcgacccccggcgctgcatgaagcccgtgatcctgaccgacggcgaggagcgggtcatcctggccgggccgatgcccgtgacccacagctccgcggcccagcgccgcggccggatcgggcgcaaccccaagaacgagaacgaccagtacatctacatgggcgagcccctcgagaacgacgaggactgcgcccactggaaggaggccaagatgctgctggacaacatcaacacgccggagggcatcatccccagcatgttcgagcccgagcgggagaaggtggacgccatcgacggggagtaccgcctccggggcgaggcgcgcaagaccttcgtcgacctgatgcggcgcggggacctgccggtgtggctcgcctaccgggtggccgccgagggcatcaactacgccgaccgccggtggtgcttcgacgggatcaagaacaaccagatcctggaggagaacgtcgaggtggagatctggaccaaggagggcgagcgcaagaagctgaagccccggtggctcgacgcgcgcatctactccgaccccctggccctgaaggagttcaaggagttcgccgccggccgcaagagcctcaccctgaacctgatcacggagatggggcgcctccccaccttcatgacccagaaggcgcgggacgccctggacaacctggccgtcctccacaccgccgaggccggcgggcgcgcgtacaaccacgccctgtccgagctgccggagacgctcgagaccctgctgctcctgaccctgctcgccaccgtgacgggcggcatcttcctgttcctgatgagcgggaagggcatcgggaagatgaccctcggcatgtgctgcatcatcaccgcctccatcctgctgtggtacgcccagatccagccccactggatcgcggccagcatcatcctcgagttcttcctgatcgtgctgctcatccccgagcccgagaagcagcggaccccgcaggacaaccagctgacctacgtcgtgatcgccatcctgacggtggtcgccgccaccatggcgaacgagatggggttcctcgagaagaccaagaaggacctgggcctgggcagcatcaccacgcaggagtccgagagcaacatcctcgacatcgacctgcgccccgcctccgcctggaccctgtacgccgtggccaccaccttcgtgacgcccatgctccggcacagcatcgagaactccagcgtcaacgtgtccctgaccgcgatcgccaaccaggccaccgtgctgatggggctcggcaaggggtggcccctgagcaagatggacatcggcgtcccgctgctcgccatcgggtgctactcccaggtgaaccccatcaccctgacggcggccctgctcctgctggtggcccactacgccatcatcggccccggcctccaggccaaggcgacccgcgaggcccagaagcgcgccgccgccgggatcatgaagaaccccaccgtcgacggcatcaccgtgatcgacctggagccgatcccctacgaccccaagttcgagaagcagctgggccaggtgatgctcctgatcctgtgcgtcacccaggtgctcatgatgcggaccacctgggcgctgtgcgaggccctgaccctcgccacgggccccatcagcaccctgtgggaggggaacccgggccgcttctggaacaccaccatcgccgtgtccatggccaacatcttccggggcagctacctggcgggggccggcctcctgttctccatcatgaagaacacgaccaacacccgccgggggaccggcaacatcggcgagacgctgggggagaagtggaagtcccgcctcaacgccctgggcaagtccgagttccagatctacaagaagtccgggatccaggaggtcgaccggaccctggccaaggagggcatcaagcgcggggagaccgaccaccacgcggtgtcccggggcagcgccaagctccgctggttcgtggagcggaacatggtcacccccgagggcaaggtggtggacctggggtgcggccgcgggggctggtcctactactgcgggggcctgaagaacgtccgggaggtgaagggcctcacgaagggcgggcccgggcacgaggagcccatcccgatgagcacctacggctggaacctggtgcgcctgcagagcggggtcgacgtgttcttcacgccgcccgagaagtgcgacaccctcctgtgcgacatcggcgagtccagccccaacccgacgatcgaggccggccggaccctgcgcgtgctcaacctggtcgagaactggctgaacaacaacacccagttctgcgtgaaggtgctcaacccctacatgccctccgtcatcgagaagatggagaccctgcagcggaagtacgggggcgccctggtgcgcaacccgctgagccggaactccacccacgagatgtactgggtgagcaacgccacggggaacatcgtctccagcgtgaacatgatctcccgcatgctcatcaaccgcttcaccatgaagcacaagaaggcgacctacgagcccgacgtggacctgggcagcgggacccggaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcctccagcatggtcaacggggtggtgcggctcctgacgaagccgtgggacgtcgtgcccatggtgacccagatggccatgaccgacaccacgcccttcggccagcagcgcgtcttcaaggagaaggtggacacccggacccaggagcccaaggagggcaccaagaagctgatgaagatcacggccgagtggctctggaaggagctggggaagaagaagaccccgcgcatgtgcacccgggaggagttcacccgcaaggtgcggtccaacgcggccctgggcgccatcttcacggacgagaacaagtggaagtccgcccgcgaggccgtcgaggactcccggttctgggagctcatcgaccgcgagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttcagccgggggaactccctgagcggcgtcgagggggagggcctccaccgcctgggctacatcctgcgggacgtgtccaagaaggagggcggggcgatgtacgccgacgacaccgccgggtgggacacccgcatcacgctcgaggacctgaagaacgaggagatggtgaccaaccacatgaagggcgagcacaagaagctggccgaggccatcttcaagctcacctaccagaacaaggtcgtgcgggtgcagcgccccacgccccgggggacggtcatggacatcatcagccggcgcgaccagcggggctccggccaggtggggacctacggcctgaacaccttcaccaacatggaggcgcagctgatccgccagatggagggggagggcatcttcaagagcatccagcacctcacggtgaccgaggagatcgccgtccagaactggctggcccgggtgggccgcgagcggctgtcccgcatggccatcagcggggacgactgcgtggtcaagcccctcgacgaccggttcgcctccgcgctgaccgccctgaacgacatgggcaaggtgcgcaaggacatccagcagtgggagccgagccgggggtggaacgactggacccaggtgcccttctgctcccaccacttccacgagctcgtcatgaaggacggccgcgtgctggtggtcccctgccggaaccaggacgagctgatcgggcgcgcccggatcagccagggcgccggctggtccctcaaggagacggcctgcctgggcaagagctacgcgcagatgtggaccctgatgtacttccaccgccgggacctccgcctggccgccaacgccatctgctccgccgtgcccagccactgggtgccgacctcccggaccacctggagcatccacgcgaagcacgagtggatgacgaccgaggacatgctggccgtctggaaccgcgtgtggatccaggagaacccctggatggaggacaagacccccgtggagagctgggaggaggtcccctacctcggcaagcgcgaggaccagtggtgcgggtccctgatcggcctgaccagccgggccacgtgggccaagaacatccagaccgcgatcaaccaggtgcgctccctcatcgggaacgaggagtacaccgactacatgccgagcatgaagcggttccgccgggaggaggaggaggccggcgtgctgtggtga

SEQ ID NO: 9462 - RNA, 9876 nt, synthetic construct
  misc_feature 1..9876: note = derived and/or modified CDS sequence (opt1) from DENV-2__EU482741__SS-prME
  source 1..9876: mol_type = other RNA
accgcgggggtcatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccgcaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggtcgtgtccttcgtgaccctgatcacggggaacatgagcttccgggacctcggccgcgtcatggtgatggtgggggccaccatgaccgacgacatcggcatgggcatcacctacctggccctgctcgccgcgttcaaggtccgccccacgttcgccgccgggctgctgctccggaagctgacctccaaggagctgatgatggccaccatcggcatcgccctcctgagccagtccaccatccccgagacgatcctggagctcaccgacgcgctggccctggggatgatggtgctcaagatcgtgcgcaacatggagaagtaccagctggccgtcaccatcatggccatcagctgcgtgccgaacgccgtgatcctgcagaacgcgtggaaggtctcctgcaccatcctcgccgccgtgagcgtcagccccctgctgctcacgagctcccagcagaaggccgactggatccccctggcgctgaccatcaagggcctcaaccccaccgccatcttcctgaccacgctgagccggacctccaagaagcgcagctggccgctcaacgaggccatcatggccgtgggcatggtgtccatcctggccagcagcctgctcaagaacgacatccccatgaccgggcccctggtcgcgggcgggctgctcaccgtgtgctacgtgctgacgggccggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtgttcccggtcagcatccccatcaccgcggccgcctggtacctctgggaggtgaagaagcagcgcgccggcgtgctgtgggacgtccccagcccgccgcccgtggagaaggccgagctggaggacggggcgtaccggatcaagcagcgcggcatcctcgggtacagccagatcggcgccggcgtgtacaaggaggggaccttccacaccatgtggcacgtcacccggggcgccgtgctgatgcaccgcgggaagcggatcgagccctcctgggccgacgtgaagaaggacctgatcagctacggcgggggctggaagctcgagggcgagtggaaggagggggaggaggtccaggtgctggccctggagcccggcaagaacccccgcgcggtgcagacgaagcccggcctcttcaagaccaacaccggcaccatcggggccgtctccctggacttcagccccggcacgtccggcagccccatcgtggaccggaaggggaaggtggtcggcctgtacgggaacggcgtggtgacccgctccggcgcctacgtcagcgccatcgcgcagaccgagaagtccatcgaggacaaccccgagatcgaggacgacatcttccggaagaagcgcctcaccatcatggacctgcaccccggggccggcaagacgaagcggtacctgcccgccatcgtgcgcgaggccatcaagcgggggctgcgcaccctcatcctggccccgacccgcgtggtcgcggccgagatggaggaggccctgcggggcctccccatccgctaccagacccccgccatccgggccgagcacacggggcgcgagatcgtggacctgatgtgccacgcgaccttcaccatgcggctgctctcccccgtgcgcgtcccgaactacaacctgatcatcatggacgaggcccacttcaccgaccccgccagcatcgccgcccggggctacatctccacgcgcgtggagatgggcgaggcggccgggatcttcatgaccgccacgccgcccggcagccgggacccgttcccccagtccaacgcccccatcatggacgaggagcgcgagatccccgagcggagctggaactccgggcacgagtgggtgaccgacttcaagggcaagacggtctggttcgtgccgagcatcaaggcggggaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggcgccaacttcaaggcggagcgggtcatcgacccccgccggtgcatgaagcccgtgatcctgaccgacggggaggagcgcgtgatcctggccggccccatgccggtcacccacagctccgccgcccagcggcgcgggcgcatcggccggaaccccaagaacgagaacgaccagtacatctacatgggggagcccctcgagaacgacgaggactgcgcccactggaaggaggcgaagatgctgctggacaacatcaacacccccgagggcatcatcccgagcatgttcgagcccgagcgcgagaaggtggacgccatcgacggcgagtaccggctccgcggggaggcccggaagacgttcgtggacctgatgcgccggggcgacctgcccgtctggctcgcctaccgcgtggccgcggaggggatcaactacgccgaccggcgctggtgcttcgacggcatcaagaacaaccagatcctggaggagaacgtggaggtcgagatctggaccaaggagggggagcggaagaagctgaagccgcgctggctcgacgcccggatctactccgaccccctggccctgaaggagttcaaggagttcgcggccggccgcaagagcctcaccctgaacctgatcaccgagatgggccggctccccacgttcatgacccagaaggcccgcgacgccctggacaacctggccgtgctccacaccgcggaggccgggggccgggcctacaaccacgccctgtccgagctgcccgagaccctcgagacgctgctgctcctgaccctgctcgccaccgtcaccgggggcatcttcctgttcctgatgagcggcaaggggatcggcaagatgacgctcgggatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgccatcctgaccgtggtggcggccacgatggccaacgagatgggcttcctcgagaagaccaagaaggacctggggctgggcagcatcgccacccaggagtccgagagcaacatcctcgacatcgacctgcggccggcctccgcgtggaccctgtacgccgtcgccacgaccttcgtgacccccatgctccgccacagcatcgagaactccagcgtgaacgtctccctgaccgccatcgcgaaccaggccacggtgctgatgggcctcgggaagggctggcccctgagcaagatggacatcggggtgcccctgctcgccatcggctgctactcccaggtcaacccgatcaccctgaccgccgccctgctcctgctggtggcgcactacgccatcatcgggcccggcctccaggccaaggccacccgggaggcccagaagcgcgcggccgccggcatcatgaagaaccccacggtggacgggatcaccgtcatcgacctggagcccatcccgtacgaccccaagttcgagaagcagctgggccaggtgatgctcctgatcctgtgcgtgacccaggtcctcatgatgcgcaccacgtgggccctgtgcgaggccctgaccctcgcgaccgggcccatcagcaccctgtgggagggcaaccccgggcggttctggaacacgaccatcgccgtgtccatggccaacatcttccgcggcagctacctggccggcgcggggctcctgttctccatcatgaagaacaccaccaacacgcggcgcggcaccgggaacatcggcgagaccctgggcgagaagtggaagtcccggctcaacgccctggggaagtccgagttccagatctacaagaagtccggcatccaggaggtggaccgcaccctggccaaggaggggatcaagcggggcgagacggaccaccacgccgtctcccgcgggagcgccaagctccggtggttcgtggagcgcaacatggtgaccccggagggcaaggtcgtggacctgggctgcgggcggggcgggtggtcctactactgcggcgggctgaagaacgtgcgcgaggtcaagggcctcaccaagggcgggcccggccacgaggagcccatccccatgagcacctacgggtggaacctggtgcggctgcagagcggcgtggacgtcttcttcacgccgcccgagaagtgcgacaccctcctgtgcgacatcggggagtccagccccaaccccaccatcgaggcgggccgcaccctgcgggtgctcaacctggtggagaactggctgaacaacaacacgcagttctgcatcaaggtcctcaacccgtacatgccctccgtgatcgagaagatggagaccctgcagcgcaagtacggcggggccctggtgcggaaccccctgagccgcaactccacccacgagatgtactgggtcagcaacgccaccggcaacatcgtgtccagcgtgaacatgatctcccggatgctcatcaaccgcttcaccatgaagcacaagaaggccacgtacgagccggacgtcgacctggggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtgaacggcgtggtccgcctcctgaccaagccctgggacgtggtgccgatggtcacccagatggccatgacggacaccacccccttcgggcagcagcgggtgttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtccgctccaacgccgccctgggggcgatcttcaccgacgagaacaagtggaagtccgcccgggaggccgtggaggactcccgcttctgggagctcatcgaccgggagcgcaacctgcacctggagggcaagtgcgagacctgcgtgtacaacatgatggggaagcgggagaagaagctcggcgagttcgggaaggccaagggcagccgcgcgatctggtacatgtggctgggcgcccggttcctggagttcgaggccctcgggttcctgaacgaggaccactggttcagccgcggcaactccctgagcggggtcgagggcgaggggctccaccggctgggctacatcctgcgcgacgtgtccaagaaggagggcggggccatgtacgccgacgacacggcgggctgggacacccggatcaccctcgaggacctgaagaacgaggagatggtcaccaaccacatgaagggggagcacaagaagctggccgaggccatcttcaagctcacgtaccagaacaaggtggtgcgcgtccagcggccgacgccccgcggcaccgtgatggacatcatcagccgccgggaccagcgcgggtccggccaggtgggcacctacgggctgaacacgttcaccaacatggaggcccagctgatccggcagatggagggcgaggggatcttcaagagcatccagcacctcaccgtcaccgaggagatcgccgtgcagaactggctggcgcgcgtgggccgggagcgcctgtcccggatggccatcagcggcgacgactgcgtcgtgaagcccctcgacgaccgcttcgcctccgccctgacggccctgaacgacatggggaaggtgcggaaggacatccagcagtgggagcccagccgcggctggaacgactggacccaggtcccgttctgctcccaccacttccacgagctcgtgatgaaggacgggcgggtgctggtcgtgccctgccgcaaccaggacgagctgatcggccgggcgcgcatcagccagggggccggctggtccctcaaggagaccgcctgcctgggcaagagctacgcccagatgtggaccctgatgtacttccaccggcgcgacctccggctggccgcgaacgccatctgctccgccgtgcccagccactgggtccccacgtcccgcaccacctggagcatccacgccaagcacgagtggatgaccaccgaggacatgctggcggtgtggaaccgggtgtggatccaggagaacccgtggatggaggacaagacgcccgtcgagagctgggaggaggtgccctacctcgggaagcgcgaggaccagtggtgcggctccctgatcgggctgaccagccgcgccacctgggccaagaacatccagaccgccatcaaccaggtgcggtccctcatcggcaacgaggagtacacggactacatgcccagcatgaagcgcttccggcgcgaggaggaggaggccggggtcctgtggtga

SEQ ID NO: 9463 - RNA, 9876 nt, synthetic construct
  misc_feature 1..9876: note = derived and/or modified CDS sequence (opt1) from DENV-2__EU482742__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggcccccgagatccagatgagcagcggcaacctcctgttcacgggccacctgaagtgccgcctccggatggacaagctgcagctgaaggggatgtcctacagcatgtgcaccggcaagttcaagatcgtgaaggagatcgccgagacccagcacgggaccatcgtgatccgcgtccagtacgagggcgacggctccccctgcaagatcccgttcgagatcatggacctcgagaagcggcacgtgctggggcgcctgatcacggtgaaccccatcgtcaccgagaaggacagccccgtgaacatcgaggcggagcccccgttcggcgactcctacatcatcatcggggtggagcccggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggccatggtccaggcggactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcaccccggagctgaaccacatcctcagcgagaacgaggtgaagctgaccatcatgacgggcgacatcaaggggatcatgcaggccggcaagcggtccctgcgcccccagcccaccgagctcaagtacagctggaagacctggggcaaggcgaagatgctgtccaccgagagccacaaccagacgttcctgatcgacgggccggagaccgccgagtgccccaacaccaaccgggcctggaactccctcgaggtcgaggactacggcttcggggtgttcaccacgaacatctggctgaagctgcgcgagaagcaggacgtgttctgcgacagcaagctcatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggccggtgagccagcacaactaccgccccggctaccacacccagaccgcggggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgccgcccctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgcgatcctcctggtggccgtctccttcgtgaccctgatcacggggaacatgagcttccgggacctcggccgcgtgatggtcatggtgggggccaccatgaccgacgacatcggcatgggcgtgacctacctggccctgctcgccgcgttcaaggtccgccccacgttcgccgccgggctgctgctccggaagctgacctccaaggagctgatgatggccaccatcggcatcgccctcctgagccagtccaccatcccggagacgatcctggagctcaccgacgcgctggccctggggatgatggtgctcaagatcgtgcgcaacatggagaagtaccagctggccgtcaccatcatggccatcagctgcgtgcccaacgccgtgatcctgcagaacgcgtggaaggtctcctgcaccatcctcgccgccgtgagcgtcagccccctgctgctcacgagctcccagcagaaggccgactggatccccctggcgctgaccatcaagggcctcaacccgaccgccatcttcctgaccacgctgagccggacctccaagaagcgcagctggcccctcaacgaggccatcatggccgtgggcatggtgtccatcctggccagcagcctgctcaagaacgacatccccatgaccgggcccctggtcgcgggcgggctgctcaccgtgtgctacgtgctgacgggccggtccgccgacctggagctcgagcgcgccgccgacgtcaagtgggaggaccaggccgagatcagcgggtccagcccgatcctgtccatcaccatcagcgaggacggctccatgagcatcaagaacgaggaggaggagcagaccctgaccatcctcatccggacgggcctgctggtgatctccggggtgttccccgtcagcatccccatcaccgcggccgcctggtacctctgggaggtgaagaagcagcgcgccggcgtgctgtgggacgtcccctccccgccgcccgtggggaaggccgagctggaggacggcgcgtaccggatcaagcagcgcgggatcctcggctacagccagatcggcgccggggtgtacaaggagggcaccttccacaccatgtggcacgtcacccgcggggccgtgctgatgcaccgcggcaagcggatcgagccgtcctgggccgacgtgaagaaggacctgatcagctacgggggcggctggaagctcgagggggagtggaaggagggcgaggaggtccaggtgctggccctggagcccgggaagaacccccgcgcggtgcagacgaagcccggcctcttcaagaccaacaccgggaccatcggcgccgtctccctggacttcagcccgggcacgtccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgccggccatcgtgcgcgaggccatcaagcggggcctgcgcaccctcatcctggcccccacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctctccccggtgcgcgtccccaactacaacctgatcatcatggacgaggcccacttcaccgaccccgccagcatcgccgcccggggctacatctccacgcgcgtggagatgggggaggcggccggcatcttcatgaccgccacgccgcccgggagccgggaccccttcccccagtccaacgcccccatcatggacgaggagcgcgagatccccgagcggagctggaactccggccacgagtgggtgaccgacttcaaggggaagacggtctggttcgtgcccagcatcaaggcgggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggccaacttcaaggcggagcgggtcatcgacccccgccggtgcatgaagcccgtgatcctgaccgacggcgaggagcgcgtgatcctggccgggccgatgcccgtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacaccccggagggcatcatccccagcatgttcgagcccgagcgcgagaaggtggacgccatcgacggggagtaccggctccgcggcgaggcccggaagacgttcgtggacctgatgcgccgcggggacctgccggtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccccgctggctcgacgcccggatctactccgaccccctggccctgaaggagttcaaggagttcgcggccggccgcaagagcctcaccctgaacctgatcaccgagatggggcggctccccacgttcatgacccagaaggcccgcgacgccctggacaacctggccgtgctccacaccgcggaggccggcgggcgggcctacaaccacgccctgtccgagctgccggagaccctcgagacgctgctgctcctgaccctgctcgccgcggtcaccggcggcatcttcctgttcctgatgagcgggaagggcatcgggaagatgaccctcggcatgtgctgcatcatcacggcctccatcctgctgtggtacgcccagatccagccccactggatcgccgccagcatcatcctcgagttcttcctgatcgtgctgctcatccccgagcccgagaagcagcgcaccccgcaggacaaccagctgacctacgtggtcatcgcgatcctgaccgtggtggccgccaccatggccaacgagatggggttcctcgagaagacgaagaaggacctgggcctgggcagcatcaccacccaggagtccgagagcaacatcctcgacatcgacctgcggcccgcctccgcgtggaccctgtacgccgtcgccacgaccttcgtgacccccatgctccgccacagcatcgagaactccagcgtgaacgtctccctgaccgccatcgcgaaccaggccacggtgctgatggggctcggcaaggggtggcccctgagcaagatggacatcggcgtgccgctgctcgccatcgggtgctactcccaggtcaaccccatcaccctgaccgccgccctgctcctgctggtggcgcactacgccatcatcggccccggcctccaggccaaggccacccgggaggcccagaagcgcgcggccgccgggatcatgaagaaccccacggtggacggcatcaccgtcatcgacctggagccgatcccctacgaccccaagttcgagaagcagctggggcaggtcatgctcctgatcctgtgcgtgacccaggtcctcatgatgcgcaccacgtgggccctgtgcgaggccctgaccctcgcgaccggccccatcagcaccctgtgggaggggaacccgggccggttctggaacacgaccatcgccgtgtccatggccaacatcttccgcggcagctacctggccggggcgggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtggaccgcaccctggccaaggagggcatcaagcgcggggagacggaccaccacgccgtctcccgcggcagcgccaagctccggtggttcgtggagcgcaacatggtgacccccgagggcaaggtcgtggacctggggtgcggccgcggcgggtggtcctactactgcggcgggctgaagaacgtgcgcgaggtcaaggggctcaccaagggcgggcccgggcacgaggagcccatcccgatgagcacctacggctggaacctggtgcggctgcagagcggggtggacgtcttcttcacgccgcccgagaagtgcgacaccctcctgtgcgacatcggcgagtccagccccaacccgaccatcgaggcgggccgcaccctgcgggtgctcaacctggtggagaactggctgaacaacaacacgcagttctgcatcaaggtcctcaacccctacatgccctccgtgatcgagaagatggagaccctgcagcgcaagtacgggggcgccctggtgcggaacccgctgagccgcaactccacccacgagatgtactgggtcagcaacgccaccgggaacatcgtgtccagcgtgaacatgatctcccggatgctcatcaaccgcttcaccatgaagcacaagaaggccacgtacgagcccgacgtcgacctgggcagcgggacccgcaacatcggcatcgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcgtccagcatggtgaacggggtggtccgcctcctgaccaagccgtgggacgtggtgcccatggtcacccagatggccatgacggacaccacccccttcggccagcagcgggtgttcaaggagaaggtggacacccgcacgcaggagcccaaggagggcaccaagaagctgatgaagatcaccgccgagtggctctggaaggagctggggaagaagaagaccccgcggatgtgcacgcgcgaggagttcacccggaaggtccgctccaacgccgccctgggcgcgatcttcaccgacgagaacaagtggaagtccgcccgggaggccgtggaggactcccgcttctgggagctcatcgaccgggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttcagccgcgggaactccctgagcggcgtcgagggggagggcctccaccggctgggctacatcctgcgcgacgtgtccaagaaggagggcggggccatgtacgccgacgacacggcggggtgggacacccggatcaccctcgaggacctgaagaacgaggagatggtcaccaaccacatgaagggcgagcacaagaagctggccgaggccatcttcaagctcacgtaccagaacaaggtggtgcgcgtccagcggcccacgccccgggggaccgtgatggacatcatcagccgccgggaccagcgcggctccggccaggtggggacctacggcctgaacacgttcaccaacatggaggcccagctgatccggcagatggagggggagggcatcttcaagagcatccagcacctcaccgtcaccgaggagatcgccgtgcagaactggctggcgcgcgtgggccgggagcgcctgtcccggatggccatcagcggggacgactgcgtcgtgaagcccctcgacgaccgcttcgcctccgccctgacggccctgaacgacatgggcaaggtgcggaaggacatccagcagtgggagccgagccgcgggtggaacgactggacccaggtccccttctgctcccaccacttccacgagctcgtgatgaaggacggccgggtgctggtcgtgccctgccgcaaccaggacgagctgatcgggcgggcgcgcatcagccagggcgccggctggtccctcaaggagaccgcctgcctgggcaagagctacgcccagatgtggaccctgatgtacttccaccggcgcgacctccggctggccgcgaacgccatctgctccgccgtgcccagccactgggtcccgacgtcccgcaccacctggagcatccacgccaagcacgagtggatgaccaccgaggacatgctggcggtgtggaaccgggtgtggatccaggagaacccctggatggaggacaagacgcccgtcgagagctgggaggaggtgccctacctcggcaagcgcgaggaccagtggtgcgggtccctgatcggcctgaccagccgcgccacctgggccaagaacatccagaccgccatcaaccaggtgcggtccctcatcgggaacgaggagtacacggactacatgccgagcatgaagcgcttccggcgcgaggaggaggaggccggcgtcctgtggtga

SEQ ID NO: 9464 - RNA, 9876 nt, synthetic construct
  misc_feature 1..9876: note = derived and/or modified CDS sequence (opt1) from DENV-2__EU482744__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagaacaaggagctgaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtcgaggactacggcttcggggtgttcacgaccaacatctggctgaagctgcgcgagaagcaggacgtgttctgcgactccaagctcatgagcgccgccatcaaggacaaccgggcggtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgccgggcccgtctcccagcacaactaccgcccgggctaccacacccagacggcggggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcaccaagcacgcgatcctcctggtggccgtcagcttcgtgacgctgatcaccgggaacatgtccttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgaccagcaaggagctgatgatggccaccatcggcatcgccctcctgtcccagagcacgatccccgagaccatcctggagctcaccgacgcgctggccctggggatgatggtgctcaagatcgtgcgcaacatggagaagtaccagctggccgtctccatcatggccatcagctgcgtgccgaacgccgtgatcctgcagaacgcgtggaaggtctcctgcaccatcctcgccgccgtgagcgtcagccccctgctgctcacgagctcccagcagaaggccgactggatccccctggcgctgaccatcaagggcctcaaccccaccgccatcttcctgaccacgctgagccggacctccaagaagcgcagctggccgctcaacgaggccatcatggccgtgggcatggtgtccatcctggccagcagcctgctcaagaacgacatccccatgaccgggcccctggtcgcgggcgggctgctcaccgtgtgctacgtgctgacgggccggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtgttcccggtcagcatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctacagccagatcggcgccggggtgtacaaggagggcaccttccacaccatgtggcacgtcacccgcggggccgtgctgatgcaccgcggcaagcggatcgagccctcctgggccgacgtgaagaaggacctgatcagctacgggggcggctggaagctcgagggggagtggaaggagggcgaggaggtccaggtgctggccctggagcccgggaagaacccccgcgcggtgcagacgaagcccggcctcttcaagaccaacaccgggaccatcggcgccgtctccctggacttcagccccggcacgtccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggccccgacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctctcccccgtgcgcgtcccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggccaacttcaaggcggagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccatcgacggggagtaccggctccgcggcgaggcccggaagacgttcgtggacctgatgcgccgcggggacctgcccgtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcaccgagatggggcggctccccacgttcatgacccagaaggcccgcgacgccctggacaacctggccgtgctccacaccgcggaggccggcgggcgggcctacaaccacgccctgtccgagctgcccgagaccctcgagacgctgctgctcctgaccctgctcgccaccgtcaccggcggcatcttcctgttcctgatgagcgggaagggcatcgggaagatgacgctcggcatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgccatcctgaccgtggtggcggccacgatggccaacgagatggggttcctcgagaagaccaagaaggacctgggcctgggcagcatcaccacccaggagtccgagagcaacatcctcgacatcgacctgcggccggcctccgcctggacgctgtacgcggtcgccaccaccttcgtgacccccatgctccgccacagcatcgagaactccagcgtgaacgtctccctgacggccatcgccaaccaggcgaccgtgctgatggggctcggcaaggggtggcccctgagcaagatggacatcggcgtgcccctgctcgccatcgggtgctactcccaggtcaacccgatcaccctgaccgccgccctgctcctgctggtggcccactacgcgatcatcggccccggcctccaggccaaggccacgcgggaggcccagaagcgcgccgcggccgggatcatgaagaaccccaccgtggacggcatcaccgtcatcgacctggagcccatcccgtacgaccccaagttcgagaagcagctggggcaggtcatgctcctgatcctgtgcgtgacccaggtcctcatgatgcgcacgacctgggccctgtgcgaggccctgaccctcgccaccggccccatcagcacgctgtgggaggggaaccccggccggttctggaacaccaccatcgcggtgtccatggccaacatcttccgcggcagctacctggccggggccggcctcctgttctccatcatgaagaacaccacgaacacccggcgcgggaccggcaacatcggcgagaccctgggggagaagtggaagtcccggctcaacgcgctgggcaagtccgagttccagatctacaagaagtccgggatccaggaggtggaccgcacgctggccaaggagggcatcaagcgcggggagaccgaccaccacgccgtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcaccaagggcgggcccgggcacgaggagcccatccccatgagcacgtacggctggaacctggtgcggctgcagagcggggtggacgtcttcttcaccccgcccgagaagtgcgacaccctcctgtgcgacatcggcgagtccagccccaaccccaccatcgaggccggccgcacgctgcgggtgctcaacctggtggagaactggctgaacaacaacacccagttctgcatcaaggtcctcaacccgtacatgccctccgtgatcgagaagatggagaccctgcagcgcaagtacgggggcgcgctggtgcggaaccccctgagccgcaactccacccacgagatgtactgggtcagcaacgccaccgggaacatcgtgtccagcgtgaacatgatctcccggatgctcatcaaccgcttcacgatgaagcacaagaaggccacctacgagccggacgtcgacctgggcagcgggacccgcaacatcggcatcgagtccgagatccccaacctggacatcatcggcaagcggatcgagaagatcaagcaggagcacgagaccagctggcactacgaccaggaccacccctacaagacgtgggcctaccacgggtcctacgagaccaagcagaccggcagcgcctccagcatggtgaacggggtggtccgcctcctgaccaagccctgggacgtggtgccgatggtcacgcagatggcgatgaccgacaccacccccttcggccagcagcgggtgttcaaggagaaggtggacacgcgcacccaggagcccaaggagggcaccaagaagctgatgaagatcaccgccgagtggctctggaaggagctggggaagaagaagacgccccggatgtgcacccgcgaggagttcacccggaaggtccgctccaacgccgccctgggcgccatcttcaccgacgagaacaagtggaagtccgcgcgggaggccgtggaggactcccgcttctgggagctcatcgaccgggagcgcaacctgcacctggaggggaagtgcgagacgtgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttcagccgcgggaactccctgagcggcgtcgagggggagggcctccaccggctgggctacatcctgcgcgacgtgtccaagaaggagggcggggccatgtacgccgacgacaccgccgggtgggacacccggatcaccctcgaggacctgaagaacgaggagatggtcacgaaccacatgaagggcgagcacaagaagctggcggaggccatcttcaagctcacctaccagaacaaggtggtgcgcgtccagcggccgacgccccgggggaccgtgatggacatcatcagccgccgggaccagcgcggctccggccaggtggggacgtacggcctgaacaccttcaccaacatggaggcccagctgatccggcagatggagggggagggcatcttcaagagcatccagcacctcaccgtcacggaggagatcgccgtgcagaactggctggcccgcgtgggccgggagcgcctgtcccggatggcgatcagcggggacgactgcgtcgtgaagcccctcgacgaccgcttcgcctccgccctgaccgccctgaacgacatgggcaaggtgcggaaggacatccagcagtgggagcccagccgcgggtggaacgactggacccaggtcccgttctgctcccaccacttccacgagctcgtgatgaaggacggccgggtgctggtcgtgccctgccgcaaccaggacgagctgatcgggcgggcccgcatcagccagggcgcgggctggtccctcaaggagaccgcctgcctgggcaagagctacgcccagatgtggacgctgatgtacttccaccggcgcgacctccggctggccgccaacgcgatctgctccgccgtgcccagccactgggtccccacctcccgcaccacctggagcatccacgccaagcacgagtggatgaccacggaggacatgctggccgtgtggaaccgggtgtggatccaggagaacccgtggatggaggacaagacccccgtcgagagctgggaggaggtgccctacctcggcaagcgcgaggaccagtggtgcgggtccctgatcggcctgaccagccgcgcgacctgggccaagaacatccagacggccatcaaccaggtgcggtccctcatcgggaacgaggagtacaccgactacatgcccagcatgaagcgcttccggaaggaggaggaggaggccggcgtcctgtggtga

SEQ ID NO: 9465 - RNA, 9876 nt, synthetic construct
  misc_feature 1..9876: note = derived and/or modified CDS sequence (opt1) from DENV-2__EU482745__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccgcaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagtccaaggagctgaagtgcggcagcgggatcttcatcaccgacaacgtccacacgtggaccgagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgacgatcatgaccggcgacatcaaggggatcatgcaggccggcaagcggtccctgcgcccgcagcccaccgagctcaagtacagctggaagacctggggcaaggcgaagatgctgtccacggagagccacaaccggaccttcctgatcgacgggcccgagaccgccgagtgcccgaacaccaaccgcgcctggaactccctcgaggtcgaggactacggcttcggggtgttcacgaccaacatctggctgaagctgcgggagaagcaggacgtgttctgcgacagcaagctcatgtccgccgccatcaaggacaaccgcgcggtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccggccgggctaccacacccagacggcggggccctggcacctgggcaagctggagatggacttcgacttctgcgaggggaccaccgtggtggtcaccgaggactgcggcaaccgcggccccagcctccggacgaccaccgcctccgggaagctgatcaccgagtggtgctgccgcagctgcacgctgcccccgctccggtaccgcggcgaggacgggtgctggtacggcatggagatccggcccctgaaggagaaggaggagaacctggtgaactccctcgtgaccgccgggcacggccagatcgacaacttcagcctgggcgtcctggggatggccctcttcctggaggagatgctgcgcacccgggtgggcaccaagcacgcgatcctcctggtggccgtctccttcgtgacgctgatcaccgggaacatgagcttccgcgacctcggccgcgtgatggtcatggtgggggccaccatgaccgacgacatcggcatgggcgtgacgtacctggccctgctcgccgcgttcaaggtccggcccaccttcgccgccgggctgctgctccgcaagctgacctccaaggagctgatgatggccaccatcggcatcgccctcctgagccagtccacgatccccgagaccatcctggagctcaccgacgcgctggccctggggatgatggtgctcaagatcgtgcggaacatggagaagtaccagctggccgtcaccatcatggccatcagctgcgtgccgaacgccgtgatcctgcagaacgcgtggaaggtctcctgcacgatcctcgccgccgtgagcgtcagccccctgctgctcaccagctcccagcagaaggccgactggatccccctggcgctgaccatcaagggcctcaaccccaccgccatcttcctgacgaccctgagccgcacctccaagaagcggagctggccgctcaacgaggccatcatggccgtgggcatggtgtccatcctggccagcagcctgctcaagaacgacatccccatgaccgggcccctggtcgcgggcgggctgctcacggtgtgctacgtgctgaccggccgctccgccgacctggagctcgagcgggccgccgacgtcaagtgggaggaccaggccgagatcagcgggtccagccccatcctgtccatcaccatcagcgaggacggctccatgagcatcaagaacgaggaggaggagcagaccctgacgatcctcatccgcaccggcctgctggtgatctccggggtgttcccggtcagcatccccatcaccgcggccgcctggtacctctgggaggtgaagaagcagcgggccggcgtgctgtgggacgtccccagcccgccgcccgtggggaaggccgagctggaggacggcgcgtaccgcatcaagcagcgggggatcctcggctacagccagatcggcgccggggtgtacaaggagggcaccttccacaccatgtggcacgtcacgcgcggggccgtgctgatgcaccggggcaagcgcatcgagccctcctgggccgacgtgaagaaggacctgatcagctacgggggcggctggaagctcgagggggagtggaaggagggcgaggaggtccaggtgctggccctggagcccgggaagaacccccgggcggtgcagaccaagcccggcctcttcaagaccaacaccgggacgatcggcgccgtctccctggacttcagccccggcacctccgggagccccatcgtggaccgcaagggcaaggtggtcgggctgtacggcaacggcgtggtgacccggtccggggcctacgtcagcgccatcgcgcagaccgagaagtccatcgaggacaaccccgagatcgaggacgacatcttccgcaagaagcggctcacgatcatggacctgcaccccggcgccgggaagaccaagcgctacctgcccgccatcgtgcgggaggccatcaagcgcggcctgcgcaccctcatcctggccccgacccgggtggtcgcggccgagatggaggaggccctgcgcgggctccccatccggtaccagacgcccgccatccgcgccgagcacaccggccgggagatcgtggacctgatgtgccacgcgaccttcaccatgcgcctgctctcccccgtgcgggtcccgaactacaacctgatcatcatggacgaggcccacttcacggaccccgccagcatcgccgcccgcggctacatctccacccgggtggagatgggggaggcggccggcatcttcatgaccgccacgccgcccgggagccgcgacccgttcccccagtccaacgcccccatcatggacgaggagcgggagatccccgagcgcagctggaactccggccacgagtgggtgacggacttcaaggggaagaccgtctggttcgtgccgagcatcaaggcgggcaacgacatcgccgcctgcctgcggaagaacggcaagaaggtgatccagctctcccgcaagaccttcgacagcgagtacgtcaagacccgggccaacgactgggacttcgtggtgacgaccgacatctccgagatgggggccaacttcaaggcggagcgcgtcatcgacccccggcgctgcatgaagcccgtgatcctgaccgacggcgaggagcgggtgatcctggccgggcccatgccggtcacccacagctccgccgcccagcgccgcggccggatcgggcgcaaccccaagaacgagaacgaccagtacatctacatgggcgagcccctcgagaacgacgaggactgcgcccactggaaggaggcgaagatgctgctggacaacatcaacacgcccgagggcatcatcccgagcatgttcgagcccgagcgggagaaggtggacgccatcgacggggagtaccgcctccggggcgaggcccgcaagaccttcgtggacctgatgcggcgcggggacctgcccgtctggctcgcctaccgggtggccgcggagggcatcaactacgccgaccgccggtggtgcttcgacgggatcaagaacaaccagatcctggaggagaacgtggaggtcgagatctggaccaaggagggcgagcgcaagaagctgaagccgcggtggctcgacgcccgcatctactccgaccccctggccctgaaggagttcaaggagttcgcggccggccggaagtccctcaccctgaacctgatcacggagatggggcgcctccccaccttcatgacccagaaggcccgggacgccctggacaacctggccgtgctccacaccgcggaggccggcgggcgcgcctacaaccacgccctgtccgagctgcccgagacgctcgagaccctgctgctcctgaccctgctcgccaccgtcacgggcggcatcttcctgttcctgatgagcgggaagggcatcgggaagatgaccctcggcatgtgctgcatcatcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgccatcctgacggtggtggcggccaccatggccaacgagatggggttcctcgagaagaccaagaaggacctgggcctgggcagcatcaccacgaaggagtccgagagcaacatcctcgacatcgacctgcgcccggcctccgcctggaccctgtacgcggtcgccaccaccttcgtgacgcccatgctccggcacagcatcgagaactccagcgtgaacgtctccctgaccgccatcgccaaccaggcgaccgtgctgatggggctcggcaaggggtggcccctgagcaagatggacatcggcgtgcccctgctcgccatcgggtgctactcccaggtcaacccgatcaccctgacggccgccctgctcctgctggtggcccactacgcgatcatcggccccggcctccaggccaaggccacccgcgaggcccagaagcgcgccgcggccgggatcatgaagaaccccaccgtggacggcatcaccgtcatcgacctggagcccatcccgtacgaccccaagttcgagaagcagctggggcaggtcatgctcctgatcctgtgcgtgacgcaggtcctcatgatgcggaccacctgggccctgtgcgaggccctgaccctcgccacgggccccatcagcaccctgtgggaggggaaccccggccgcttctggaacaccaccatcgcggtgtccatggccaacatcttccggggcagctacctggccggggccggcctcctgttctccatcatgaagaacacgaccaacacccgccgggggaccggcaacatcggcgagacgctgggggagaagtggaagtcccgcctcaacgcgctgggcaagtccgagttccagatctacaagaagtccgggatccaggaggtggaccggaccctggccaaggagggcatcaagcgcggggagaccgaccaccacgccgtctcccggggcagcgccaagctccgctggttcgtggagcggaacatggtgaccccggagggcaaggtcgtggacctggggtgcggccgcgggggctggtcctactactgcgggggcctgaagaacgtgcgggaggtcaagggcctcacgaagggcgggcccgggcacgaggagcccatccccatgagcacctacggctggaacctggtgcgcctgcagagcggggtggacgtcttcttcaccccgcccgagaagtgcgacaccctcctgtgcgacatcggcgagtccagccccaaccccacgatcgaggccggccggaccctgcgcgtgctcaacctggtggagaactggctgaacaacaacacccagttctgcatcaaggtcctcaacccgtacatgccctccgtgatcgagaagatggagaccctgcagcggaagtacgggggcgcgctggtgcgcaaccccctgagccggaactccacccacgagatgtactgggtcagcaacgccacggggaacatcgtgtccagcgtgaacatgatctcccgcatgctcatcaaccgcttcaccatgaagcacaagaaggccacctacgagccggacgtcgacctgggcagcgggacccggaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcctccagcatggtgaacggggtggtccggctcctgacgaagccctgggacgtggtgccgatggtcacccagatggcgatgaccgacaccacgcccttcggccagcagcgcgtgttcaaggagaaggtggacacccggacccaggagcccaaggagggcaccaagaagctgatgaagatcacggccgagtggctctggaaggagctggggaagaagaagacgccccgcatgtgcacccgggaggagttcacccgcaaggtccggtccaacgccgccctgggcgccatcttcacggacgagaacaagtggaagtccgcgcgcgaggccgtggaggactcccggttctgggagctcatcgaccgcgagcggaacctgcacctggaggggaagtgcgagacctgcgtgtacaacatgatgggcaagcgcgagaagaagctcggggagttcggcaaggccaagggcagccgggccatctggtacatgtggctgggggcgcgcttcctggagttcgaggccctcggcttcctgaacgaggaccactggttcagccgggggaactccctgagcggcgtcgagggggagggcctccaccgcctgggctacatcctgcgggacgtgtccaagaaggagggcggggccatgtacgccgacgacaccgccgggtgggacacccgcatcacgctcgaggacctgaagaacgaggagatggtcaccaaccacatgaagggcgagcacaagaagctggcggaggccatcttcaagctcacctaccagaacaaggtggtgcgggtccagcgcccgacgccccgcgggacggtgatggacatcatcagccggcgcgaccagcggggctccggccaggtggggacctacggcctgaacaccttcaccaacatggaggcccagctgatccgccagatggagggggagggcatcttcaagagcatccagcacctcacggtcaccgaggagatcgccgtgcagaactggctggcccgggtgggccgcgagcggctgtcccgcatggcgatcagcggggacgactgcgtcgtgaagcccctcgacgaccggttcgcctccgccctgaccgccctgaacgacatgggcaaggtgcgcaaggacatccagcagtgggagcccagccgggggtggaacgactggacccaggtcccgttctgctcccaccacttccacgagctcgtgatgaaggacggccgcgtgctggtcgtgccctgccggaaccaggacgagctgatcgggcgcgcccggatcagccagggcgcgggctggtccctcaaggagacggcctgcctgggcaagagctacgcccagatgtggaccctgatgtacttccaccgccgggacctccgcctggccgccaacgcgatctgctccgccgtgcccagccactgggtccccacctcccggaccacctggagcatccacgccaagcacgagtggatgacgaccgaggacatgctggccgtgtggaaccgcgtgtggatccaggagaacccgtggatggaggacaagacccccgtcgagagctgggaggaggtgccctacctcggcaagcgcgaggaccagtggtgcgggtccctgatcggcctgaccagccgggcgacgtgggccaagaacatccagaccgccatcaaccaggtgaagtccctcatcgggaacgaggagtacaccgactacatgcccagcatgaagcgcttccggcgcgaggaggaggaggccggcgtcctgtggtga

SEQ ID NO: 9466 - RNA, 9876 nt, synthetic construct
  misc_feature 1..9876: note = derived and/or modified CDS sequence (opt1) from DENV-2__EU482746__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccgcaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagtccaaggagctgaagtgcggcagcgggatcttcatcaccgacaacgtccacacgtggaccgagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgacgatcatgaccggcgacatcaaggggatcatgcaggccggcaagcggtccctgcgcccgcagcccaccgagctcaagtacagctggaagacctggggcaaggcgaagatgctgtccacggagagccacaaccggaccttcctgatcgacgggcccgagaccgccgagtgcccgaacaccaaccgcgcctggaactccctcgaggtcgaggactacggcttcggggtgttcacgaccaacatctggctgaagctgcgggagaagcaggacgtgttctgcgacagcaagctcatgtccgccgccatcaaggacaaccgcgcggtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccggccgggctaccacacccagacggcggggccctggcacctgggcaagctggagatggacttcgacttctgcgaggggaccaccgtggtggtcaccgaggactgcggcaaccgcggccccagcctccggacgaccaccgcctccgggaagctgatcaccgagtggtgctgccgcagctgcacgctgcccccgctccggtaccgcggcgaggacgggtgctggtacggcatggagatccggcccctgaaggagaaggaggagaacctggtgaactccctcgtgaccgccgggcacggccagatcgacaacttcagcctgggcgtcctggggatggccctcttcctggaggagatgctgcgcacccgggtgggcaccaagcacgcgatcctcctggtggccgtctccttcgtgacgctgatcaccgggaacatgagcttccgcgacctcggccgcgtgatggtcatggtgggggccaccatgaccgacgacatcggcatgggcgtgacgtacctggccctgctcgccgcgttcaaggtccggcccaccttcgccgccgggctgctgctccgcaagctgacctccaaggagctgatgatggccaccatcggcatcgccctcctgagccagtccacgatccccgagaccatcctggagctcaccgacgcgctggccctggggatgatggtgctcaagatcgtgcggaacatggagaagtaccagctggccgtcaccatcatggccatcagctgcgtgccgaacgccgtgatcctgcagaacgcgtggaaggtctcctgcacgatcctcgccgccgtgagcgtcagccccctgctgctcaccagctcccagcagaaggccgactggatccccctggcgctgaccatcaagggcctcaaccccaccgccatcttcctgacgaccctgagccgcacctccaagaagcggagctggccgctcaacgaggccatcatggccgtgggcatggtgtccatcctggccagcagcctgctcaagaacgacatccccatgaccgggcccctggtcgcgggcgggctgctcacggtgtgctacgtgctgaccggccgctccgccgacctggagctcgagcgggccgccgacgtcaagtgggaggaccaggccgagatcagcgggtccagccccatcctgtccatcaccatcagcgaggacggctccatgagcatcaagaacgaggaggaggagcagaccctgacgatcctcatccgcaccggcctgctggtgatctccggggtgttcccggtcagcatccccatcaccgcggccgcctggtacctctgggaggtgaagaagcagcgggccggcgtgctgtgggacgtccccagcccgccgcccgtggggaaggccgagctggaggacggcgcgtaccgcatcaagcagcgggggatcctcggctacagccagatcggcgccggggtgtacaaggagggcaccttccacaccatgtggcacgtcacgcgcggggccgtgctgatgcaccggggcaagcgcatcgagccctcctgggccgacgtgaagaaggacctgatcagctacgggggcggctggaagctcgagggggagtggaaggagggcgaggaggtccaggtgctggccctggagcccgggaagaacccccgggcggtgcagaccaagcccggcctcttcaagaccaacaccgggacgatcggcgccgtctccctggacttcagccccggcacctccgggagccccatcgtggaccgcaagggcaaggtggtcgggctgtacggcaacggcgtggtgacccggtccggggcctacgtcagcgccatcgcgcagaccgagaagtccatcgaggacaaccccgagatcgaggacgacatcttccgcaagaagcggctcacgatcatggacctgcaccccggcgccgggaagaccaagcgctacctgcccgccatcgtgcgggaggccatcaagcgcggcctgcgcaccctcatcctggccccgacccgggtggtcgcggccgagatggaggaggccctgcgcgggctccccatccggtaccagacgcccgccatccgcgccgagcacaccggccgggagatcgtggacctgatgtgccacgcgaccttcaccatgcgcctgctctcccccgtgcgggtcccgaactacaacctgatcatcatggacgaggcccacttcacggaccccgccagcatcgccgcccgcggctacatctccacccgggtggagatgggggaggcggccggcatcttcatgaccgccacgccgcccgggagccgcgacccgttcccccagtccaacgcccccatcatggacgaggagcgggagatccccgagcgcagctggaactccggccacgagtgggtgacggacttcaaggggaagaccgtctggttcgtgccgagcatcaaggcgggcaacgacatcgccgcctgcctgcggaagaacggcaagaaggtgatccagctctcccgcaagaccttcgacagcgagtacgtcaagacccgggccaacgactgggacttcgtggtgacgaccgacatctccgagatgggggccaacttcaaggcggagcgcgtcatcgacccccggcgctgcatgaagcccgtgatcctgaccgacggcgaggagcgggtgatcctggccgggcccatgccggtcacccacagctccgccgcccagcgccgcggccggatcgggcgcaaccccaagaacgagaacgaccagtacatctacatgggcgagcccctcgagaacgacgaggactgcgcccactggaaggaggcgaagatgctgctggacaacatcaacacgcccgagggcatcatcccgagcatgttcgagcccgagcgggagaaggtggacgccatcgacggggagtaccgcctccggggcgaggcccgcaagaccttcgtggacctgatgcggcgcggggacctgcccgtctggctcgcctaccgggtggccgcggagggcatcaactacgccgaccgccggtggtgcttcgacgggatcaagaacaaccagatcctggaggagaacgtggaggtcgagatctggaccaaggagggcgagcgcaagaagctgaagccgcggtggctcgacgcccgcatctactccgaccccctggccctgaaggagttcaaggagttcgcggccggccggaagtccctcaccctgaacctgatcacggagatggggcgcctccccaccttcatgacccagaaggcccgggacgccctggacaacctggccgtgctccacaccgcggaggccggcgggcgcgcctacaaccacgccctgtccgagctgcccgagacgctcgagaccctgctgctcctgaccctgctcgccaccgtcacgggcggcatcttcctgttcctgatgagcgggaagggcatcgggaagatgaccctcggcatgtgctgcatcatcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgccatcctgacggtggtggcggccaccatggccaacgagatggggttcctcgagaagaccaagaaggacctgggcctgggcagcatcaccacgcaggagtccgagagcaacatcctcgacatcgacctgcgcccggcctccgcctggaccctgtacgcggtcgccaccaccttcgtgacgcccatgctccggcacagcatcgagaactccagcgtgaacgtctccctgaccgccatcgccaaccaggcgaccgtgctgatggggctcggcaaggggtggcccctgagcaagatggacatcggcgtgcccctgctcgccatcgggtgctactcccaggtcaacccgatcaccctgacggccgccctgctcctgctggtggcccactacgcgatcatcggccccggcctccaggccaaggccacccgcgaggcccagaagcgcgccgcggccgggatcatgaagaaccccaccgtggacggcatcaccgtcatcgacctggagcccatcccgtacgaccccaagttcgagaagcagctggggcaggtcatgctcctgatcctgtgcgtgacgcaggtcctcatgatgcggaccacctgggccctgtgcgaggccctgaccctcgccacgggccccatcagcaccctgtgggaggggaaccccggccgcttctggaacaccaccatcgcggtgtccatggccaacatcttccggggcagctacctggccggggccggcctcctgttctccatcatgaagaacacgaccaacacccgccgggggaccggcaacatcggcgagacgctgggggagaagtggaagtcccgcctcaacgcgctgggcaagtccgagttccagatctacaagaagtccgggatccaggaggtggaccggaccctggccaaggagggcatcaagcgcggggagaccgaccaccacgccgtctcccggggcagcgccaagctccgctggttcgtggagcggaacatggtgaccccggagggcaaggtcgtggacctggggtgcggccgcgggggctggtcctactactgcgggggcctgaagaacgtgcgggaggtcaagggcctcacgaagggcgggcccgggcacgaggagcccatccccatgagcacctacggctggaacctggtgcgcctgcagagcggggtggacgtcttcttcaccccgcccgagaagtgcgacaccctcctgtgcgacatcggcgagtccagccccaaccccacgatcgaggccggccggaccctgcgcgtgctcaacctggtggagaactggctgaacaacaacacccagttctgcatcaaggtcctcaacccgtacatgccctccgtgatcgagaagatggagaccctgcagcggaagtacgggggcgcgctggtgcgcaaccccctgagccggaactccacccacgagatgtactgggtcagcaacgccacggggaacatcgtgtccagcgtgaacatgatctcccgcatgctcatcaaccgcttcaccatgaagcacaagaaggccacctacgagccggacgtcgacctgggcagcgggacccggaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcctccagcatggtgaacggggtggtccggctcctgacgaagccctgggacgtggtgccgatggtcacccagatggcgatgaccgacaccacgcccttcggccagcagcgcgtgttcaaggagaaggtggacacccggacccaggagcccaaggagggcaccaagaagctgatgaagatcacggccgagtggctctggaaggagctggggaagaagaagacgccccgcatgtgcacccgggaggagttcacccgcaaggtccggtccaacgccgccctgggcgccatcttcacggacgagaacaagtggaagtccgcgcgcgaggccgtggaggactcccggttctgggagctcatcgaccgcgagcggaacctgcacctggaggggaagtgcgagacctgcgtgtacaacatgatgggcaagcgcgagaagaagctcggggagttcggcaaggccaagggcagccgggccatctggtacatgtggctgggggcgcgcttcctggagttcgaggccctcggcttcctgaacgaggaccactggttcagccgggggaactccctgagcggcgtcgagggggagggcctccaccgcctgggctacatcctgcgggacgtgtccaagaaggagggcggggccatgtacgccgacgacaccgccgggtgggacacccgcatcacgctcgaggacctgaagaacgaggagatggtcaccaaccacatgaagggcgagcacaagaagctggcggaggccatcttcaagctcacctaccagaacaaggtggtgcgggtccagcgcccgacgccccgcgggacggtgatggacatcatcagccggcgcgaccagcggggctccggccaggtggggacctacggcctgaacaccttcaccaacatggaggcccagctgatccgccagatggagggggagggcatcttcaagagcatccagcacctcacggtcaccgaggagatcgccgtgcagaactggctggcccgggtgggccgcgagcggctgtcccgcatggcgatcagcggggacgactgcgtcgtgaagcccctcgacgaccggttcgcctccgccctgaccgccctgaacgacatgggcaaggtgcgcaaggacatccagcagtgggagcccagccgggggtggaacgactggacccaggtcccgttctgctcccaccacttccacgagctcgtgatgaaggacggccgcgtgctggtcgtgccctgccggaaccaggacgagctgatcgggcgcgcccggatcagccagggcgcgggctggtccctcaaggagacggcctgcctgggcaagagctacgcccagatgtggaccctgatgtacttccaccgccgggacctccgcctggccgccaacgcgatctgctccgccgtgcccagccactgggtccccacctcccggaccacctggagcatccacgccaagcacgagtggatgacgaccgaggacatgctggccgtgtggaaccgcgtgtggatccaggagaacccgtggatggaggacaagacccccgtcgagagctgggaggaggtgccctacctcggcaagcgcgaggaccagtggtgcgggtccctgatcggcctgaccagccgggcgacgtgggccaagaacatccagaccgccatcaaccaggtgcgctccctcatcgggaacgaggagtacaccgactacatgcccagcatgaagcggttccgccgggaggaggaggaggccggcgtcctgtggtga

SEQ ID NO: 9467 - RNA, 9876 nt, synthetic construct
  misc_feature 1..9876: note = derived and/or modified CDS sequence (opt1) from DENV-2__EU482590__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccgtcctgggggacaccgcctgggacttcggcagcctcgggggcgtgttcacctccatcgggaaggccctgcaccaggtgttcggcgcgatctacggcgccgccttcagcggggtctcctggaccatgaagatcctgatcggcgtgatcatcacgtggatcgggatgaacagccgctccaccagcctgtccgtgagcctcgtcctggtgggcgtggtcaccctgtacctcggggccatggtgcaggcggactccggctgcgtggtcagctggaagaacaaggagctgaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtcaagctgacgatcatgaccggcgacatcaaggggatcatgcaggccggcaagcggagcctgcgcccgcagcccaccgagctcaagtactcctggaagacctggggcaaggcgaagatgctgagcacggagccccacaaccagaccttcctgatcgacgggccggagaccgccgagtgccccaacaccaaccgggcctggaactccctcgaggtggaggactacggcttcggggtgttcacgaccaacatctggctgaagctgcgcgagaagcaggacgtcttctgcgacagcaagctcatgtccgccgccatcaaggacaaccgggcggtgcacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggccggtgagccagcacaactaccgccccggctaccacacccagacggcggggccctggcacctgggcaagctggagatggacttcgacttctgcgaggggaccaccgtggtcgtgaccgaggactgcggcaaccggggcccctccctccgcacgaccaccgccagcgggaagctgatcaccgagtggtgctgccggagctgcacgctgccgcccctccgctaccggggcgaggacgggtgctggtacggcatggagatccgccccctgaaggagaaggaggagaacctggtgaactccctcgtcaccgccgggcacggccagatcgacaacttcagcctgggcgtgctggggatggccctcttcctggaggagatgctgcggacccgcgtgggcaccaagcacgcgatcctcctggtcgccgtgtccttcgtgacgctgatcaccgggaacatgagcttccgggacctcggccgcgtcatggtgatggtgggggccaccatgaccgacgacatcggcatgggcgtcacgtacctggccctgctcgccgcgttcaaggtgcgccccaccttcgccgccgggctgctgctccggaagctgacctccaaggagctgatgatggccaccatcggcatcgccctcctgagccagtccacgatcccggagaccatcctggagctcaccgacgcgctggccctggggatgatggtgctcaagatcgtccgcaacatggagaagtaccagctggccgtgaccatcatggccatcagctgcgtgcccaacgccgtcatcctgcagaacgcgtggaaggtgtcctgcacgatcctcgccgccgtcagcgtgagccccctgctgctcaccagctcccagcagaaggccgactggatccccctggcgctgaccatcaagggcctcaacccgaccgccatcttcctgacgaccctgagccggacctccaagaagcgcagctggcccctcaacgaggccatcatggccgtgggcatggtctccatcctggccagctccctgctcaagaacgacatccccatgaccgggcccctggtggcgggcgggctgctcacggtgtgctacgtcctgaccggccggagcgccgacctggagctcgagcgcgccgccgacgtgaagtgggaggaccaggccgagatcagcgggtccagcccgatcctgtccatcaccatcagcgaggacggctccatgagcatcaagaacgaggaggaggagcagaccctgacgatcctcatccggaccggcctgctggtgatctccggggtcttccccgtgagcatccccatcaccgcggccgcctggtacctctgggaggtgaagaagcagcgcgccggcgtcctgtgggacgtgccctccccgccgcccgtggggaaggccgagctggaggacggcgcgtaccggatcaagcagcgcgggatcctcggctacagccagatcggcgccggggtctacaaggagggcaccttccacaccatgtggcacgtgacgcgcggggccgtgctgatgcaccgcggcaagcggatcgagccgtcctgggccgacgtcaagaaggacctgatcagctacgggggcggctggaagctcgagggggagtggaaggagggcgaggaggtccaggtgctggccctggagcccgggaagaacccccgcgcggtccagaccaagcccggcctcttcaagaccaacaccgggacgatcggcgccgtgtccctggacttcagcccgggcacctccgggagccccatcgtggaccggaagggcaaggtcgtggggctgtacggcaacggcgtggtcacccgctccggggcctacgtgagcgccatcgcgcagaccgagaagtccatcgaggacaaccccgagatcgaggacgacatcttccggaagaagcgcctcacgatcatggacctgcaccccggcgccgggaagaccaagcggtacctgccggccatcgtgcgcgaggccatcaagcggggcctgcgcaccctcatcctggcccccacccgcgtcgtggcggccgagatggaggaggccctgcgggggctccccatccgctaccagacgcccgccatccgggccgagcacaccggccgcgagatcgtggacctgatgtgccacgcgaccttcaccatgcggctgctcagcccggtccgcgtgcccaactacaacctgatcatcatggacgaggcccacttcacggaccccgccagcatcgccgcccggggctacatctccacccgcgtggagatgggggaggcggccggcatcttcatgaccgccacgccgcccgggagccgggaccccttcccccagtccaacgcccccatcctggacgaggagcgcgagatccccgagcggagctggaactccggccacgagtgggtcacggacttcaaggggaagaccgtgtggttcgtgcccagcatcaaggcgggcaacgacatcgccgcctgcctccgcaagaacggcaagaaggtcatccagctgtcccggaagaccttcgacagcgagtacgtgaagacccgcgccaacgactgggacttcgtggtcacgaccgacatctccgagatgggggccaacttcaaggcggagcgggtgatcgacccccgccggtgcatgaagcccgtgatcctgaccgacggcgaggagcgcgtcatcctcgccgggccgatgcccgtgacccacagctccgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacgccggagggcatcatccccagcatgttcgagcccgagcgcgagaaggtggacgccatcgacggggagtaccggctgcgcggcgaggcccggaagaccttcgtcgacctgatgcgccgcggggacctcccggtgtggctggcctaccgcgtggccgcggagggcatcaactacgccgaccggcgctggtgcttcgacgggatcaagaacaaccagatcctggaggagaacgtcgaggtggagatctggaccaaggagggcgagcggaagaagctcaagccccgctggctggacgcccggatctactccgaccccctggccctcaaggagttcaaggagttcgcggccggccgcaagagcctgaccctgaacctcatcacggagatggggcggctgcccaccttcatgacccagaaggcccgcgacgccctggacaacctcgccgtcctgcacaccgcggaggtgggcgggcgggcctacaaccacgccctgtccgagctcccggagacgctggagaccctgctcctgctgaccctcctggccaccgtgacgggcggcatcttcctgttcctcatgagcgggaagggcatcgggaagatgaccctgggcatgtgctgcatcatcaccgcctccatcctgctctggtacgcgcagatccagccccactggatcgccgccagcatcatcctggagttcttcctgatcgtcctcctgatccccgagcccgagaagcagcgcaccccgcaggacaaccagctgacctacgtggtgatcgccatcctcacggtcgtggccgcgaccatggccaacgagatggggttcctggagaagaccaagaaggacctgggcctcggctccatcaccacgcaggagagcgagagcaacatcctggacatcgacctgcggcccgcctccgcctggaccctctacgccgtggcgaccaccttcgtcacgcccatgctgcgccacagcatcgagaactccagcgtgaacatctccctgaccgccatcgccaaccaggccaccgtgctcatggggctgggcaaggggtggcccctgagcaagatggacatcggcgtcccgctcctggcgatcgggtgctactcccaggtgaaccccatcaccctgacggccgccctcctgctgctcgtggcccactacgccatcatcggccccggcctgcaggcgaaggccacccgggaggcccagaagcgcgccgccgcggggatcatgaagaaccccaccgtcgacggcatcaccgtgatcgacctggagccgatcccctacgaccccaagttcgagaagcagctcggccaggtgatgctgctgatcctctgcgtcacccaggtgctgatgatgcgcaccacctgggccctgtgcgaggccctcaccctggccacgggccccatcagcaccctgtgggaggggaacccgggccggttctggaacaccaccatcgccgtgtccatggcgaacatcttccgcggcagctacctcgccggggccggcctgctgttctccatcatgaagaacacgaccaacacccggcgcgggaccggcaacatcggcgagacgctcggggagaagtggaagtcccggctgaacgccctgggcaagtccgagttccagatctacaagaagtccgggatccaggaggtcgaccgcaccctcgcgaaggagggcatcaagcgcggggagaccgaccaccacgccgtgtcccgcggcagcgccaagctgcggtggttcgtggagcgcaacatggtcacccccgagggcaaggtggtggacctggggtgcggccgcggcgggtggtcctactactgcggcgggctcaagaacgtccgcgaggtgaaggggctgacgaagggcgggcccgggcacgaggagcccatcccgatgagcacctacggctggaacctggtgcggctccagtccggggtcgacgtgttcttcacgccgcccgagaagtgcgacaccctgctgtgcgacatcggcgagagcagccccaacccgacgatcgaggccggccgcaccctccgggtgctgaacctggtcgagaactggctcaacaacaacacccagttctgcatcaaggtgctgaacccctacatgccctccgtgatcgagaagatggagaccctgcagcgcaagtacgggggcgccctggtccggaacccgctcagccgcaactccacccacgagatgtactgggtgagcaacgcgacggggaacatcgtgtccagcgtcaacatgatctcccggatgctgatcaaccgcttcaccatgaagcacaagaaggccacctacgagcccgacgtggacctgggcagcgggacccgcaacatcggcatcgagtccgagatccccaacctcgacatcatcggcaagcggatcgagaagatcaagcaggagcacgagacgagctggcactacgaccaggaccacccctacaagacctgggcctaccacgggtcctacgagaccaagcagaccggcagcgcctccagcatggtgaacggggtcgtgcgcctgctgacgaagccgtgggacgtggtccccatggtgacccagatggccatgaccgacaccacgcccttcggccagcagcgggtgttcaaggagaaggtcgacacccgcacccaggagcccaaggagggcaccaagaagctcatgaagatcacggcggagtggctgtggaaggagctggggaagaagaagaccccgcggatgtgcacccgcgaggagttcacccggaaggtgcgctccaacgccgccctcggcgccatcttcacggacgagaacaagtggaagtccgcccgggaggcggtggaggactcccgcttctgggagctgatcgaccgggagcgcaacctgcacctcgaggggaagtgcgagacctgcgtctacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgggaacagcctcagcggcgtggagggggagggcctgcaccggctgggctacatcctccgcgacgtctccaagaaggagggcggggccatgtacgccgacgacaccgccgggtgggacacccggatcacgctggaggacctgaagaacgaggagatggtgaccaaccacatgaagggcgagcacaagaagctcgccgaggcgatcttcaagctgacctaccagaacaaggtggtccgcgtgcagcggcccacgccccgggggacggtgatggacatcatcagccgccgggaccagcgcggctccggccaggtcgggacctacggcctgaacaccttcaccaacatggaggcccagctcatccggcagatggagggggagggcatcttcaagagcatccagcacctgacggtgaccgaggagatcgccgtgcagaactggctggcccgcgtcggccgggagcgcctctcccggatggccatcagcggggacgactgcgtggtgaagcccctggacgaccgcttcgcgtccgccctgaccgccctcaacgacatgggcaaggtccggaaggacatccagcagtgggagccgagccgcgggtggaacgactggacccaggtgcccttctgctcccaccacttccacgagctggtgatgaaggacggccgggtcctggtggtgccctgccgcaaccaggacgagctcatcgggcgggcccgcatcagccagggcgccggctggtccctgaaggagacggcgtgcctgggcaagagctacgcccagatgtggaccctcatgtacttccaccggcgcgacctgcggctggccgccaacgccatctgctccgcggtccccagccactgggtgccgacctcccgcaccacctggagcatccacgccaagcacgagtggatgacgaccgaggacatgctcgccgtgtggaaccgggtctggatccaggagaacccctggatggaggacaagacccccgtggagtcctgggaggaggtgccctacctgggcaagcgcgaggaccagtggtgcgggagcctgatcggcctcaccagccgcgccacgtgggcgaagaacatccagaccgccatcaaccaggtccggtccctgatcgggaacgaggagtacaccgactacatgccgagcatgaagcgcttccggcgcgaggaggaggaggccggcgtgctgtggtga

SEQ ID NO: 9468 - RNA, 9876 nt, synthetic construct
  misc_feature 1..9876: note = derived and/or modified CDS sequence (opt1) from DENV-2__EU482594__SS-prME
  source 1..9876: mol_type = other RNA
accgcgggggtcatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccgcaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggccgtctccttcgtgaccctgatcacggggaacatgagcttccgggacctcggccgcgtgatggtcatggtgggggccaccatgaccgacgacatcggcatgggcatcacctacctggccctgctcgcggccttcaaggtgcgccccacgttcgccgccgggctgctgctcaagaagctgacctccaaggagctgatgatggccaccatcggcatcgcgctcctgagccagtccaccatccccgagacgatcctggagctcaccgacgccctggccctggggatgatggtcctcaagatcgtgcggaacatggagaagtaccagctggccgtgaccatcatggccatcagctgcgtcccgaacgcggtgatcctgcagaacgcctggaaggtgtcctgcaccatcctcgccgccgtcagcgtgagccccctgctgctcacgagctcccagcagaaggcggactggatccccctggccctgaccatcaagggcctcaaccccaccgccatcttcctgaccacgctgagccgcacctccaagaagcggagctggccgctcaacgaggccatcatggccgtcggcatggtgtccatcctggcgagcagcctgctcaagaacgacatccccatgaccgggcccctggtggccggcgggctgctcaccgtctgctacgtgctgacgggccgctccgccgacctggagctcgagcgggccgccgacgtgaagtgggaggaccaggcggagatcagcgggtccagccccatcctgtccatcaccatcagcgaggacggctccatgagcatcaagaacgaggaggaggagcagaccctgaccatcctcatccgcacgggcctgctggtcatctccggggtgttcccggtgagcatccccatcaccgccgccgcctggtacctctgggaggtcaagaagcagcgggccggcgtgctgtgggacgtgcccagcccgccgcccgtcgggaaggcggagctggaggacggcgcctaccgcatcaagcagcgggggatcctcggctacagccagatcggcgccggggtgtacaaggagggcaccttccacaccatgtggcacgtgacccgcggggccgtcctgatgcaccggggcaagcgcatcgagccctcctgggccgacgtgaagaaggacctgatcagctacgggggcggctggaagctcgagggggagtggaaggagggcgaggaggtgcaggtcctggcgctggagcccgggaagaacccccgggccgtgcagacgaagcccggcctcttcaagaccaacaccgggaccatcggcgccgtgtccctggacttcagccccggcacgtccgggagccccatcgtcgaccgcaagggcaaggtggtggggctgtacggcaacggcgtcgtgacccggtccggggcctacgtgagcgcgatcgcccagaccgagaagtccatcgaggacaaccccgagatcgaggacgacatcttccgcaagaagcggctcaccatcatggacctgcaccccggcgccgggaagacgaagcgctacctgcccgccatcgtccgggaggccatcaagcgcggcctgcggaccctcatcctggcgccgacccgcgtggtggccgccgagatggaggaggccctgcgcgggctccccatccggtaccagacccccgccatccgcgcggagcacacgggccgggagatcgtcgacctgatgtgccacgccaccttcaccatgcgcctgctctcccccgtgcgggtgccgaactacaacctgatcatcatggacgaggcccacttcaccgaccccgccagcatcgccgcgcgcggctacatctccacgcgggtcgagatgggggaggccgccggcatcttcatgaccgccacgccgcccgggagccgcgacccgttcccccagtccaacgcgcccatcatggacgaggagcgggagatccccgagcgcagctggaactccggccacgagtgggtgaccgacttcaaggggaagacggtgtggttcgtcccgagcatcaaggccggcaacgacatcgccgcctgcctgcggaagaacggcaagaaggtgatccagctctcccgcaagaccttcgacagcgagtacgtgaagacccgggccaacgactgggacttcgtcgtgaccacggacatctccgagatgggggcgaacttcaaggccgagcgcgtgatcgacccccggcgctgcatgaagcccgtcatcctgaccgagggcgaggagcgggtgatcctggccgggcccatgccggtgacccacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgggagaaggtcgacgccatcgacggggagtaccgcctccggggcgaggcccgcaagacgttcgtggacctgatgcggcgcggggacctgcccgtgtggctcgcctaccgggtcgcggccgagggcatcaactacgccgaccgccggtggtgcttcgacgggatcaagaacaaccagatcctggaggagaacgtggaggtggagatctggaccaaggagggcgagcgcaagaagctgaagccgcggtggctcgacgcccgcatctactccgaccccctggcgctgaaggagttcaaggagttcgccgccggccggaagtccctcaccctgaacctgatcaccgagatggggcgcctccccacgttcatgacccagaaggcccgggacgccctggacaacctggcggtcctccacaccgccgaggccggcgggcgcgcctacaaccacgccctgtccgagctgcccgagaccctcgagacgctgctgctcctgaccctgctcgcgaccgtgaccggcggcatcttcctgttcctgatgagcgggaagggcatcgggaagatgacgctcggcatgtgctgcatcatcaccgcctccatcctgctgtggtacgcccagatccagccgcactggatcgccgccagcatcatcctcgagttcttcctgatcgtcctgctcatccccgagcccgagaagcagcggacgccccaggacaaccagctgacctacgtggtgatcgcgatcctgaccgtcgtggccgccacgatggccaacgagatggggttcctcgagaagaccaagaaggacctgggcctgggcagcatcgccacccaggagtccgagagcaacatcctcgacatcgacctgcgcccggcgtccgcctggaccctgtacgccgtggccacgaccttcgtcacccccatgctccggcacagcatcgagaactccagcgtgaacgtgtccctgaccgcgatcgccaaccaggccacggtcctgatggggctcggcaaggggtggcccctgagcaagatggacatcggcgtgcccctgctcgccatcgggtgctactcccaggtgaacccgatcaccctgaccgccgcgctgctcctgctggtcgcccactacgccatcatcggccccggcctccaggccaaggccacccgcgaggcgcagaagcgggccgccgccgggatcatgaagaaccccacggtggacggcatcaccgtgatcgacctggagcccatcccgtacgaccccaagttcgagaagcagctggggcaggtcatgctcctgatcctgtgcgtgacccaggtgctcatgatgcgcaccacgtgggccctgtgcgaggcgctgaccctcgccaccggccccatcagcaccctgtgggaggggaaccccggccgcttctggaacacgaccatcgccgtctccatggccaacatcttccggggcagctacctggcgggggccggcctcctgttctccatcatgaagaacaccaccaacacgcgccgggggaccggcaacatcggcgagaccctgggggagaagtggaagtcccgcctcaacgccctgggcaagtccgagttccagatctacaagaagtccgggatccaggaggtggaccggaccctggccaaggagggcatcaagcgcggggagacggaccaccacgccgtgtcccggggcagcgcgaagctccgctggttcgtcgagcggaacatggtgaccccggagggcaaggtggtcgacctggggtgcggccgcgggggctggtcctactactgcgggggcctgaagaacgtgcgggaggtgaagggcctcaccaagggcgggcccgggcacgaggagcccatccccatgagcacctacggctggaacctggtccgcctgcagagcggggtggacgtgttcttcacgccgcccgagaagtgcgacaccctcctgtgcgacatcggcgagtccagccccaaccccaccatcgaggccggccggaccctgcgcgtcctcaacctggtggagaactggctgaacaacaacacgcagttctgcatcaaggtgctcaacccgtacatgccctccgtcatcgagaagatggagaccctgcagcggaagtacgggggcgccctggtgcgcaaccccctgagccggaactccacccacgagatgtactgggtgagcaacgccaccgggaacatcgtctccagcgtgaacatgatctcccgcatgctcatcaaccggttcaccatgaagcacaagaaggccacgtacgagccggacgtggacctgggcagcgggacccgcaacatcggcatcgagtccgagatccccaacctggacatcatcggcaagcgcatcgagaagatcaagcaggagcacgagaccagctggcactacgaccaggaccacccctacaagacctgggcgtaccacgggtcctacgagacgaagcagaccggcagcgcctccagcatggtcaacggggtggtgcggctcctgaccaagccctgggacgtcgtgccgatggtgacccagatggccatgacggacaccacccccttcggccagcagcgcgtcttcaaggagaaggtggacacccggacgcaggagcccaaggagggcaccaagaagctgatgaagatcaccgccgagtggctctggaaggagctggggaagaagaagacgccccgcatgtgcacgcgggaggagttcacccgcaaggtgcggtccaacgccgcgctgggcgccatcttcaccgacgagaacaagtggaagtccgcccgcgaggccgtcgaggactcccggttctgggagctcatcgaccgcgagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttcagccgggggaactccctgagcggcgtggagggggagggcctccaccgcctgggctacatcctgcgggacgtctccaagaaggagggcggggccatgtacgcggacgacacggccgggtgggacacccgcatcaccctcgaggacctgaagaacgaggagatggtgaccaaccacatgaagggcgagcacaagaagctggccgaggccatcttcaagctcacgtaccagaacaaggtcgtgcgggtgcagcgcccgacgccccgggggaccgtcatggacatcatcagccgccgcgaccagcggggctccggccaggtggggacctacggcctgaacacgttcaccaacatggaggcccagctgatccgccagatggagggggagggcatcttcaagagcatccagcacctcaccgtgaccgaggagatcgcggtccagaactggctggcccgggtgggccgcgagcggctgtcccgcatggccatcagcggggacgactgcgtggtcaagcccctcgacgaccggttcgcctccgccctgacggcgctgaacgacatgggcaaggtgcgcaaggacatccagcagtgggagcccagccgggggtggaacgactggacccaggtgccgttctgctcccaccacttccacgagctcgtcatgaaggacggccgcgtgctggtggtcccctgccggaaccaggacgagctgatcgggcgcgcccggatcagccagggcgccggctggtccctcaaggagaccgcctgcctgggcaagagctacgcccagatgtggaccctgatgtacttccaccgccgggacctccgcctggcggccaacgccatctgctccgccgtgcccagccactgggtgcccacgtcccggaccacctggagcatccacgcgaagcacgagtggatgaccaccgaggacatgctggccgtctggaaccgcgtgtggatccaggagaacccgtggatggaggacaagacgcccgtggagagctgggaggaggtcccctacctcggcaagcgggaggaccagtggtgcgggtccctgatcggcctgaccagccgcgccacctgggccaagaacatccagaccgccatcaaccaggtgcgctccctcatcgggaacgaggagtacacggactacatgcccagcatgaagcggttccgccgggaggaggaggaggcgggcgtgctgtggtga

SEQ ID NO: 9469 - RNA, 9876 nt, synthetic construct
  misc_feature 1..9876: note = derived and/or modified CDS sequence (opt1) from DENV-2__EU482604__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtcctgaagatcgtgcgcaacatggagaagtaccagctcgccgtgaccatcatggccatctcctgcgtcccgaacgccgtgatcctgcggaacgcctggaaggtgagctgcaccatcctggcggccgtctccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtcggcatggtgagcatcctcgcctccagcctgctgaagaacgacatccccatgaccgggcccctcgtggccggcgggctgctgaccgtctgctacgtgctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgcgggggtgtacaaggagggcacgttccacaccatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgcggtgagcctggacttctcccccggcaccagcgggtcccccatcgtcgaccgcaagggcaaggtggtggggctctacggcaacggcgtcgtgacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcacgctgatcctggccccgacccgggtggtggccgcggagatggaggaggccctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcgcacttcaccgaccccgcctccatcgccgcccggggctacatcagcacccgcgtcgagatgggggaggccgcgggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgcggggcccatgccggtgacccactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgcgatcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtggagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtcctgcacaccgccgaggcgggcgggcgggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcgcagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggccgcgaccatggccaacgagatggggttcctggagaagacgaagaaggacctgggcctcggcagcatcaccacccaggagagcgagtccaacatcctggacatcgacctgcggccggccagcgcctggaccctctacgccgtcgcgacgaccttcgtgacccccatgctgcgccactccatcgagaacagctccgtgaacgtcagcctgaccgccatcgccaaccaggccacggtgctcatggggctgggcaaggggtggcccctgtccaagatggacatcggcgtgcccctcctggcgatcgggtgctacagccaggtcaacccgatcaccctgaccgccgccctcctgctgctcgtggcccactacgccatcatcggccccggcctgcaggcgaaggccacccgggaggcccagaagcgcgccgccgcggggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcggaccacgtgggccctgtgcgaggccctcaccctggccaccggccccatctccaccctgtgggaggggaaccccggccgcttctggaacacgaccatcgccgtgagcatggcgaacatcttccgcggctcctacctcgccggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgcgaaggagggcatcaagcgcggggagacggaccaccacgccgtcagccgcggctccgccaagctgcggtggttcgtggagcgcaacatggtgaccccggagggcaaggtcgtggacctggggtgcggccgcggcgggtggagctactactgcggcgggctcaagaacgtgcgcgaggtcaaggggctgaccaagggcggccccgggcacgaggagcccatccccatgtccacctacggctggaacctggtgcggctccagagcggggtggacgtcttcttcacgccgcccgagaagtgcgacaccctgctgtgcgacatcggcgagagctcccccaaccccaccatcgaggccggccgcaccctccgggtgctgaacctggtggagaactggctcaacaacaacacccagttctgcatcaaggtcctgaacccgtacatgcccagcgtgatcgagaagatggagacgctgcagcgcaagtacgggggcgccctcgtgcggaaccccctgtcccgcaacagcacccacgagatgtactgggtctccaacgcgaccgggaacatcgtgagctccgtgaacatgatcagccggatgctgatcaaccgcttcaccatgaagcacaagaaggccacgtacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgcggagtggctgtggaaggagctggggaagaagaagacgccccggatgtgcacgcgggaggagttcacccgcaaggtccggagcaacgccgccctcggcgccatcttcaccgacgagaacaagtggaagtccgcccgcgaggcggtggaggacgggcggttctgggagctggtggacaaggagcgcaacctgcacctcgagggcaagtgcgagacctgcgtctacaacatgatggggaagcgggagaagaagctgggcgagttcggcaaggccaaggggagccgcgccatctggtacatgtggctgggcgcccggttcctcgagttcgaggcgctggggttcctgaacgaggaccactggttctcccgcggcaacagcctcagcggggtggagggcgagggcctgcaccggctggggtacatcctccgcgacgtcggcaagaaggagggcggcgccatgtacgccgacgacacggccgggtgggacacccggatcaccctggaggacctgaagaacgaggagatggtgaccaaccacatgaagggcgagcacaagaagctcgccgaggcgatcttcaagctgacgtaccagaacaaggtggtccgcgtgcagcggccgacgccccgcggcaccgtgatggacatcatctcccggcgcgaccagcgcgggagcggccaggtcgggacctacggcctgaacacgttcaccaacatggaggcccagctcatccggcagatggagggcgaggggatcttcaagtccatccagcacctgaccgccaccgaggagatcgccgtgcagaactggctggcccgcgtgggccgggagcgcctcagccggatggcgatctccggggacgactgcgtcgtgaagcccatcgacgaccgcttcgccagcgccctgacggccctgaacgacatgggcaaggtgcggaaggacatccagcagtgggagccctcccgcgggtggaacgactggacccaggtcccgttctgcagccaccacttccacgagctcgtgatgaaggacggccgggtgctggtcgtgccctgccgcaaccaggacgagctgatcggccgggcccgcatctcccagggggcgggctggagcctcaaggagaccgcctgcctggggaagtcctacgcccagatgtggaccctgatgtacttccaccggcgcgacctccggctggccgccaacgcgatctgcagcgccgtgccctcccactgggtccccaccagccgcacgacctggtccatccacgccaagcacgagtggatgaccaccgaggacatgctggccgtgtggaaccgggtgtggatccaggagaacccgtggatggaggacaagacgcccgtcgagagctgggaggaggtgccctacctcggcaagcgcgaggaccagtggtgcgggtccctgatcggcctgaccagccgggcgacctgggccaagaacatccagaccgccatcaaccaggtgcgcagcctcatcggcaacgaggagtacacggactacatgccctccatgaagcgcttccggcgcgaggaggaggaggccggggtcctgtggtga

SEQ ID NO: 9470 - RNA, 9876 nt, synthetic construct
  misc_feature 1..9876: note = derived and/or modified CDS sequence (opt1) from DENV-2__EU482605__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggcagctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctgctcgtcaccggccacctgaagtgccgcctgcggatggacaagctccagctgaaggggatgtcctacagcatgtgcaccggcaagttcaagatcgtgaaggagatcgccgagacccagcacgggacgatcgtgatccgcatccagtacgagggcgacggctccccctgcaagatccccttcgagatcaccgacctggagaagcggcacgtcctcgggcgcctgatcaccgtgaacccgatcgtgatcgagaaggacagccccgtcaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtcttcggggcgatctacggcgccgccttcagcggggtgtcctggaccatgaagatcctgatcggcgtggtcatcacgtggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacttctgcgaggggaccaccgtggtggtcacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacccgcgtgggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtgctgaagatcgtgcgcaacatggagaagtaccagctcgccgtcaccatcatggccatctcctgcgtgccgaacgccgtgatcctgcggaacgcctggaaggtcagctgcaccatcctggcggccgtgtccgtcagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtgggcatggtgagcatcctcgcctccagcctgctgaagaacgacatccccatgaccgggcccctcgtcgccggcgggctgctgaccgtgtgctacgtgctcaccggccgcagcgcggacctggagctggagcgggccgccgacgtcaagtgggaggaccaggccgagatctccgggagctcccccatcctcagcatcacgatctccgaggacggcagcatgtccatcaagaacgaggaggaggagcagaccctgaccatcctgatccgcaccggcctcctggtgatcagcggggtgttcccggtctccatccccatcaccgccgcggcctggtacctgtgggaggtgaagaagcagcgggccggcgtgctctgggacgtccccagcccgccgcccgtggggaaggccgagctggaggacggcgcctaccgcatcaagcagcgggggatcctgggctactcccagatcggcgcgggggtgtacaaggagggcacgttccacaccatgtggcacgtcacccgcggggccgtgctcatgcaccggggcaagcgcatcgagcccagctgggccgacgtgaagaaggacctgatctcctacgggggcggctggaagctggagggggagtggaaggagggcgaggaggtccaggtgctcgccctggagcccgggaagaacccccgggccgtgcagaccaagcccggcatcttcaagacgaacaccgggaccatcggcgcggtcagcctggacttctcccccggcaccagcgggtcccccatcgtggaccgcaagggcaaggtggtcgggctctacggcaacggcgtggtgacgcggagcggggcctacgtctccgccatcgcccagaccgagaagtccatcgaggcgaaccccgagatcgaggacgccatcttccgcaagaagcggctgaccatcatggacctgcaccccggcgccgggaagcccaagcgcagcctcccggccatcgtgcgggaggccatcaagcgcggcctgcgccccctgatcctggcgccgccccgggtggtcccggccgagatggaggagcccctccgcgggctgcccatccggtaccagacccccgccatcaagccggaccacacgggccgcgagatcgtggccctgatgtgccacgcccccttcaccatgcggctcctgtcccccgtgcgcgtccccaactacaacctgatcatcatggacgaggcgcacttcaccgacccggccagcatcgccgcccggggctacatctccacccgcgtggagatgggggaggccgcgggcatcttcatgacggccacgccgcccgggagccgggaccccttcccgcagtccaacgcccccatcatggacgaggagcgcgagatccccgagcggagctggaactccggccacgagtgggtgaccgacttcaaggggaagaccgtctggttcgtgcccagcatcaaggccggcaacgacatcgcggcctgcctccgcaagaacggcaagaaggtgatccagctgtcccggaagacgttcgacagcgagtacgtcaagacccgcgccaacgactgggacttcgtggtgaccaccgacatctccgagatgggggccaacttcaaggccgagcgggtcatcgacccgcgccggtgcatgaagcccgtgatcctgacggacggcgaggagcgcgtgatcctcgcggggcccatgccggtcacccacagctccgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgagcatgttcgagcccgagcgcgagaaggtggacgcgatcgacggggagtaccggctgcgcggcgaggcccggaagaccttcgtggacctgatgcgccgcggggacctccccgtctggctggcctacaaggtggccgccgagggcatcaactacgcggaccgcaagtggtgcttcgacgggatcaagaacaaccagatcctggaggagaacgtggaggtcgagatctggacgaaggagggcgagcggaagaagctcaagccccgctggctggacgcccggatctactccgacccgctggccctcaaggagttcaaggagttcgccgcgggccgcaagagcctgaccctgaacctcatcaccgagatggggcggctgcccaccttcatgacgcagaaggcccgcaacgccctggacaacctcgccgtgctgcacaccgccgaggcgggcgggcgggcctacaaccacgccctgtccgagctccccgagaccctggagaccctgctcctgctgacgctcctggccaccgtcaccggcggcatcttcctgttcctcatgagcgggaagggcatcgggaagatgaccctgggcatgtgctgcatcatcacggcctccgtgctgctctggtacgcgcagatccagccccactggatcgccgccagcatcatcctggagttcttcctgatcgtgctcctgatcccggagcccgagaagcagcgcacgccccaggacaaccagctgacctacgtcgtgatcgccatcctcaccgtggtcgccgcgaccatggccaacgagatggggttcctggagaagacgaagaaggacctgggcctcggcagcatcaccacccaggagtccgagagcaacatcctggacatcgacctgcggcccgcctccgcctggaccctctacgccgtggcgacgaccttcgtgaccccgatgctgcgccacagcatcgagaactccagcgtcaacgtgtccctgaccgccatcgccaaccaggccacggtgctcatggggctgggcaaggggtggcccctgagcaagatggacatcggcgtccccctcctggcgatcgggtgctactcccaggtgaaccccatcaccctgaccgccgccctcctgctgctcgtggcccactacgccatcatcggcccgggcctgcaggcgaaggccacccgggaggcccagaagcgcgccgccgcggggatcatgaagaaccccacggtcgacggcatcaccgtgatcgacctggagcccatcccctacgacccgaagttcgagaagcagctcggccaggtgatgctgctgatcctctgcgtcacccaggtgctgatgatgcggaccacgtgggccctgtgcgaggccctcaccctggccaccggccccatcagcaccctgtgggaggggaaccccggccgcttctggaacacgaccatcgccgtgtccatggcgaacatcttccgcggcagctacctcgccggggccggcctgctgttctccatcatgaagaacaccaccaacacgcggcgcgggaccggcaacatcggcgagaccctcggggagaagtggaagtcccggctgaacgccctgggcaagtccgagttccagatctacaagaagtccgggatccaggaggtcgaccgcaccctcgcgaaggagggcatcaagcgcggggagacggaccaccacgccgtgtcccgcggcagcgccaagctgcggtggttcgtggagcgcaacatggtcacccccgagggcaaggtggtggacctggggtgcggccgcggcgggtggtcctactactgcggcgggctcaagaacgtccgcgaggtgaaggggctgaccaagggcgggccggggcacgaggagcccatccccatgagcacctacggctggaacctggtgcggctccagagcggggtcgacgtgttcttcacgccgcccgagaagtgcgacaccctgctgtgcgacatcggcgagtccagccccaaccccaccatcgaggccggccgcaccctccgggtgctgaacctggtcgagaactggctcaacaacaacacgcagttctgcatcaaggtgctgaacccgtacatgccctccgtgatcgagaagatggagaccctgcagcgcaagtacgggggcgccctcgtccggaaccccctgagccgcaactccacccacgagatgtactgggtgagcaacgcgaccgggaacatcgtgtccagcgtcaacatgatctcccggatgctgatcaaccgcttcaccatgaagcacaagaaggccacgtacgagcccgacgtggacctgggcagcgggacccggaacatcggcatcgagtccgagatcccgaacctcgacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtcgtgcgcctgctgaccaagccctgggacgtggtccccatggtgacccagatggccatgacggacaccaccccgttcggccagcagcgggtgttcaaggagaaggtcgacacccgcacgcaggagcccaaggagggcaccaagcggctcatgcgcatcaccgcggagtggctgtggaaggagctggggaagaagaagacgccccggatgtgcacgcgcgaggagttcacccggaaggtgcgctccaacgccgccctcggcgccatcttcaccgacgagaacaagtggaagtccgcccgggaggcggtggaggacgggcgcttctgggagctggtcgacaaggagcggaacctgcacctcgagggcaagtgcgagacctgcgtgtacaacatgatggggaagcgcgagaagaagctgggcgagttcggcaaggccaaggggtcccgggccatctggtacatgtggctgggcgcccgcttcctcgagttcgaggcgctggggttcctgaacgaggaccactggttcagccggggcaacagcctctccggggtcgagggcgagggcctgcaccgcctggggtacatcctccgggacgtgggcaagaaggagggcggcgccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagaacaaggtcgtgcgggtgcagcgccccaccccgcggggcaccgtcatggacatcatcagccgccgcgaccagcgggggtccggccaggtggggacctacggcctgaacacgttcaccaacatggaggcccagctcatccgccagatggagggcgaggggatcttcaagagcatccagcacctgaccgccaccgaggagatcgccgtgcagaactggctggcccgggtcggccgcgagcggctctcccgcatggcgatcagcggggacgactgcgtggtgaagcccatcgacgaccggttcgcctccgccctgacggccctgaacgacatgggcaaggtccgcaaggacatccagcagtgggagcccagccgggggtggaacgactggacccaggtgcccttctgctcccaccacttccacgagctcgtgatgaaggacggccgcgtcctggtggtgccgtgccggaaccaggacgagctgatcggccgcgcccggatcagccagggggcgggctggtccctcaaggagaccgcctgcctgggcaagagctacgcccagatgtggaccctgatgtacttccaccgccgggacctccgcctggccgccaacgcgatctgctccgccgtccccagccactgggtgcccacgtcccggaccacctggagcatccacgccaagcacgagtggatgaccaccgaggacatgctggccgtgtggaaccgcgtctggatccaggagaacccctggatggaggacaagacgccggtggagtcctgggaggaggtgccctacctcggcaagcgggaggaccagtggtgcgggagcctgatcggcctgaccagccgcgcgacctgggccaagaacatccagaccgccatcaaccaggtccgctccctcatcggcaacgaggagtacacggactacatgcccagcatgaagcggttccgccgggaggaggaggaggccggggtgctgtggtga

SEQ ID NO: 9471 - RNA, 9876 nt, synthetic construct
  misc_feature 1..9876: note = derived and/or modified CDS sequence (opt1) from DENV-2__EU482606__SS-prME
  source 1..9876: mol_type = other RNA
accgccggcgtgatcatcatgctgatccccaccgccatggcgttccacctcaccacccgcaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtcctgaagatcgtgcgcaacatggagaagtaccagctcgccgtgaccatcatggccatctcctgcgtcccgaacgccgtgatcctgcggaacgcctggaaggtgagctgcaccatcctggcggccgtctccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtcggcatggtgagcatcctcgcctccagcctgctgaagaacgacatccccatgaccgggcccctcgtggccggcgggctgctgaccgtctgctacgtgctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgcgggggtgtacaaggagggcacgttccacaccatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgcggtgagcctggacttctcccccggcaccagcgggtcccccatcgtcgaccgcaagggcaaggtggtggggctctacggcaacggcgtcgtgacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcacgctgatcctggccccgacccgggtggtggccgcggagatggaggaggccctccgcgggctgcccatccggtaccagacccccgccatcaaggccgagcacaccggccgcgagatcgtcgacctgatgtgccaccccacgttcaccatgcggctcctgagcccggtgcgcgtgcccaactacaacctgatcatcatggacgaggcccacttcaccgaccccgcgtccatcgccgcccggggctacatcagcacccgcgtcgagatgggggaggccgccggcatcttcatgacggcgacgccgcccgggtcccgggaccccttcccccagagcaacgcccccatcatggacgaggagcgcgagatccccgagcggtcctggaacagcggccacgagtgggtgaccgacttcaaggggaagaccgtgtggttcgtcccctccatcaaggccggcaacgacatcgccgcgtgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgccgggccgatgcccgtgacccactccagcgcggcccagcggcgcggccgcatcgggcggaaccccaagaacgagaacgaccagtacatctacatgggcgagcccctggagaacgacgaggactgcgcccactggaaggaggccaagatgctgctcgacaacatcaacaccccggagggcatcatcccctccatgttcgagcccgagcgcgagaaggtcgacgccatcgacggggagtaccggctgcgcggcgaggcgcggaagaccttcgtggacctgatgcgccgcggggacctcccggtgtggctggcctacaaggtcgccgccgagggcatcaactacgccgaccgcaagtggtgcttcgacgggatcaagaacaaccagatcctggaggagaacgtggaggtggagatctggacgaaggagggcgagcggaagaagctcaagccccgctggctggacgcgcggatctacagcgaccccctggccctcaaggagttcaaggagttcgccgccggccgcaagtccctgaccctgaacctcatcaccgagatggggcggctgcccaccttcatgacgcagaaggcgcgcaacgccctggacaacctcgccgtcctgcacaccgccgaggccggcgggcgggcgtacaaccacgccctgagcgagctcccggagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcccagatccagccccactggatcgcggcctccatcatcctggagttcttcctgatcgtgctcctgatccccgagcccgagaagcagcgcacgccgcaggacaaccagctgacctacgtggtcatcgccatcctcaccgtggtggccgccaccatggcgaacgagatggggttcctggagaagacgaagaaggacctgggcctcggcagcatcaccacccaggagagcgagtccaacatcctggacatcgacctgcggcccgccagcgcctggaccctctacgccgtcgccacgaccttcgtgacccccatgctgcgccactccatcgagaacagctccgtgaacgtcagcctgaccgcgatcgccaaccaggccacggtgctcatggggctgggcaaggggtggcccctgtccaagatggacatcggcgtgccgctcctggccatcgggtgctacagccaggtcaaccccatcaccctgaccgcggccctcctgctgctcgtggcccactacgccatcatcggccccggcctgcaggccaaggcgacccgggaggcccagaagcgcgccgccgccgggatcatgaagaaccccacggtggacggcatcaccgtcatcgacctggagccgatcccctacgaccccaagttcgagaagcagctcggccaggtgatgctgctgatcctctgcgtgacccaggtcctgatgatgcggaccacgtgggcgctgtgcgaggccctcaccctggccaccggccccatctccaccctgtgggaggggaacccgggccgcttctggaacacgaccatcgccgtgagcatggccaacatcttccgcggctcctacctcgcgggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgccaaggagggcatcaagcgcggggagacggaccaccacgcggtcagccgcggctccgccaagctgcggtggttcgtggagcgcaacatggtgacccccgagggcaaggtcgtggacctggggtgcggccgcggcgggtggagctactactgcggcgggctcaagaacgtgcgcgaggtcaaggggctgaccaagggcggccccgggcacgaggagcccatcccgatgtccacctacggctggaacctggtgcggctccagagcggggtggacgtcttcttcacgccgcccgagaagtgcgacaccctgctgtgcgacatcggcgagagctcccccaacccgaccatcgaggccggccgcaccctccgggtgctgaacctggtggagaactggctcaacaacaacacccagttctgcatcaaggtcctgaacccctacatgcccagcgtgatcgagaagatggagacgctgcagcgcaagtacgggggcgccctcgtgcggaacccgctgtcccgcaacagcacccacgagatgtactgggtctccaacgccaccgggaacatcgtgagctccgtgaacatgatcagccggatgctgatcaaccgcttcaccatgaagcacaagaaggcgacgtacgagcccgacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccgtgggacgtggtgcccatggtcacccagatggccatgacggacaccacccccttcggccagcagcgggtgttcaaggagaaggtggacacccgcacgcaggagcccaaggagggcaccaagaagctcatgcggatcaccgccgagtggctgtggaaggagctggggaagaagaagaccccgcgcatgtgcacgcgggaggagttcacccgcaaggtccggagcaacgcggccctcggcgccatcttcaccgacgagaacaagtggaagtccgcccgcgaggccgtggaggacgggcggttctgggagctggtggacaaggagcgcaacctgcacctcgagggcaagtgcgagacctgcgtctacaacatgatggggaagcgggagaagaagctgggcgagttcggcaaggcgaaggggagccgcgccatctggtacatgtggctgggcgcccggttcctcgagttcgaggccctggggttcctgaacgaggaccactggttctcccgcggcaacagcctcagcggggtggagggcgagggcctgcaccggctggggtacatcctccgcgacgtcggcaagaaggagggcggcgcgatgtacgccgacgacacggccgggtgggacacccggatcaccctggaggacctgaagaacgaggagatggtgaccaaccacatgaagggcgagcacaagaagctcgccgaggccatcttcaagctgacgtaccagaacaaggtggtccgcgtgcagcggcccacgccccggggcaccgtgatggacatcatctcccggcgcgaccagcgcgggagcggccaggtcgggacctacggcctgaacacgttcaccaacatggaggcgcagctcatccggcagatggagggcgaggggatcttcaagtccatccagcacctgaccgccaccgaggagatcgccgtgcagaactggctggcccgcgtgggccgggagcgcctcagccggatggccatctccggggacgactgcgtcgtgaagcccatcgacgaccgcttcgcgagcgccctgacggccctgaacgacatgggcaaggtgcggaaggacatccagcagtgggagccgtcccgcgggtggaacgactggacccaggtccccttctgcagccaccacttccacgagctcgtgatgaaggacggccgggtgctggtcgtgccctgccgcaaccaggacgagctgatcggccgggcccgcatctcccagggggccggctggagcctcaaggagaccgcgtgcctggggaagtcctacgcccagatgtggaccctgatgtacttccaccggcgcgacctccggctggccgccaacgccatctgcagcgcggtgccctcccactgggtcccgaccagccgcacgacctggtccatccacgccaagcacgagtggatgaccaccgaggacatgctggccgtgtggaaccgggtgtggatccaggagaacccctggatggaggacaagacgcccgtcgagagctgggaggaggtgccctacctcggcaagcgcgaggaccagtggtgcgggtccctgatcggcctgaccagccgggccacctgggcgaagaacatccagaccgccatcaaccaggtgcgcagcctcatcggcaacgaggagtacacggactacatgccgtccatgaagcgcttccggcgcgaggaggaggaggccggggtcctgtggtga

SEQ ID NO: 9472 - RNA, 9876 nt, synthetic construct
  misc_feature 1..9876: note = derived and/or modified CDS sequence (opt1) from DENV-2__EU482607__SS-prME
  source 1..9876: mol_type = other RNA
accgcgggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcgtctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcggcctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcatcgaggccgagctgaccgggtacggcaccgtcacgatggagtgcagcccccggaccggcctcgacttcaacgagatggtgctgctgcagatggaggacaaggcctggctcgtgcaccggcagtggttcctggacctgcccctcccctggctgccgggggccgacacccagggcagcaactggatccagaaggagaccctggtcacgttcaagaacccccacgcgaagaagcaggacgtggtcgtgctcgggtcccaggagggcgccatgcacaccgccctgaccggggccaccgagatccagatgagcagcggcaacctcctcttcacgggccacctgaagtgccgcctgcggatggacaagctccagctgaaggggatgtcctacagcatgtgcaccggcaagttcaagatcgtgaaggagatcgccgagacccagcacgggaccatcgtcatccgcgtgcagtacgagggcgacggctccccctgcaagatccccttcgagatcacggacctggagaagcggcacgtgctcgggcgcctgatcaccgtcaacccgatcgtgaccggcaaggacagccccgtgaacatcgaggcggagccgcccttcggggactcctacatcatcatcggcgtcgagccggggcagctgaagctcaactggttcaagaagggcagctccatcggccagatgttcgagaccacgatgcgcggggccaagcggatggccatcctgggcgacaccgcctgggacttcgggagcctgggcggggtgttcacctccatcggcaaggccctccaccaggtgttcggcgcgatctacggggccgccttcagcggcgtctcctggaccatgaagatcctgatcggggtgatcatcacgtggatcggcatgaacagccgctccaccagcctgtccgtgagcctggtcctcgtgggggtggtcaccctgtacctgggcgccatggtgcaggcggactccggctgcgtggtcagctggaagaacaaggagctcaagtgcgggtccggcatcttcatcaccgacaacgtgcacacgtggaccgagcagtacaagttccagcccgagagccccagcaagctggcctccgccatccagaaggcccacgaggaggggatctgcggcatccggagcgtgacccgcctggagaacctcatgtggaagcagatcacccccgagctgaaccacatcctgtccgagaacgaggtcaagctcacgatcatgaccggggacatcaagggcatcatgcaggccggcaagcggagcctgcgcccgcagcccaccgagctgaagtactcctggaagacctgggggaaggcgaagatgctcagcacggagtcccacaaccagaccttcctgatcgacggccccgagaccgccgagtgcccgaacaccaaccgggcctggaacagcctggaggtggaggactacgggttcggcgtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggggtcctggagagcgagatgatcatccccaagaacttcgccggccccgtgtcccagcacaactaccgcccggggtaccacacccagacggcgggcccctggcacctcgggaagctggagatggacttcgacttctgcgagggcaccaccgtggtcgtgaccgaggactgcggcaaccgggggcccagcctgcgcacgaccaccgccagcggcaagctcatcaccgagtggtgctgccggtcctgcacgctgcccccgctgcgctaccgcggggaggacggctgctggtacgggatggagatccgccccctcaaggagaaggaggagaacctggtgaacagcctggtcaccgccggccacggccagatcgacaacttctccctcggggtgctgggcatggccctgttcctcgaggagatgctgcggacccgcgtggggaccaagcacgcgatcctgctcgtcgccgtgagcttcgtgacgctgatcaccggcaacatgtccttccgggacctggggcgcgtcatggtgatggtgggcgccaccatgaccgacgacatcggcatgggggtcacgtacctcgccctgctggccgcgttcaaggtgcgccccaccttcgccgccggcctcctgctgcggaagctcaccagcaaggagctgatgatggccaccatcgggatcgccctgctctcccagagcacgatccccgagaccatcctggagctgaccgacgcgctcgccctgggcatgatggtgctgaagatcgtccgcaacatggagaagtaccagctcgccgtgaccgtgatggccatctcctgcgtcccgaacgccgtgatcctgcagaacgcgtggaaggtcagctgcacgatcctggccgccgtgtccgtgagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtcgggatggtgagcatcctcgcctccagcctgctgaagaacgacatccccatgaccggccccctcgtggccggcgggctgctgacggtctgctacgtgctcaccgggcggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagaccctgacgatcctgatccggaccgggctcctggtcatcagcggcgtgttcccggtgtccatccccatcaccgcggccgcctggtacctgtgggaggtcaagaagcagcgcgccggggtgctctgggacgtgcccagcccgccgcccgtcggcaaggccgagctggaggacggggcgtaccggatcaagcagcgcggcatcctgggctactcccagatcggggccggcgtgtacaaggaggggaccttccacaccatgtggcacgtgacgcggggcgccgtcctcatgcaccgcgggaagcggatcgagcccagctgggccgacgtgaagaaggacctgatctcctacggcggcgggtggaagctggagggcgagtggaaggagggggaggaggtgcaggtcctcgccctggagcccggcaagaacccccgcgcggtgcagaccaagcccgggatcttcaagaccgacaccggcacgatcggcgccgtgagcctggacttctcccccgggaccagcggctcccccatcgtcgaccggaaggggaaggtggtgggcctctacggcaacggggtcgtgacccgcagcggcgcctacgtgtccgccatcgcgcagaccgagaagtccatcgaggacaaccccgagatcgaggacgacatcttccggaagaagcgcctgacgatcatggacctgcaccccggggccggcaagaccaagcggtacctccccgccatcgtccgcgaggccatcaagcgggggctgcgcaccctgatcctggccccgacccgcgtggtggcggccgagatggaggaggccctccggggcctgcccatccgctaccagacgcccgccatcaaggccgagcacaccggccgggagatcgtcgacctgatgtgccacgcgaccttcaccatgcgcctcctgagccccgtgcgggtgccgaactacaacctgatcatcatggacgaggcccacttcacggaccccgcctccatcgccgcccgcgggtacatcagcacccgggtcgagatgggcgaggcggccgggatcttcatgaccgccacgccgcccggctcccgcgacccgttcccccagagcaacgcccccatcatggacgaggagcgggagatccccgagcgctcctggaacagcgggcacgagtgggtgacggacttcaagggcaagaccgtgtggttcgtcccgtccatcaaggcgggcaacgacatcgccgcctgcctccggaagaacgggaagaaggtgatccagctgagccgcaagaccttcgactccgagtacgtgaagacccgggccaacgactgggacttcgtcgtgacgaccgacatcagcgagatgggcgccaacttcaaggcggagcgcgtgatcgacccccggcgctgcatgaagcccgtcatcctgaccgacggggaggagcgggtgatcctcgccggccccatgccggtgacccactccagcgccgcccagcgccgggggcgcatcggccgcaaccccaagaacgagaacgaccagtacatctacatgggcgagcccctggagaacgacgaggactgcgcccactggaaggaggcgaagatgctgctcgacaacatcaacacgcccgaggggatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcctacaaggtcgccgcggaggggatcaactacgccgaccggaagtggtgcttcgacggcatcaagaacaaccagatcctggaggagaacgtggaggtcgagatctggaccaaggagggcgagcgcaagaagctcaagccgcggtggctggacgcccgcatctacagcgaccccctggccctcaaggagttcaaggagttcgcggccgggcggaagtccctggccctgaacctcatcaccgagatgggccgcctgcccacgttcatgacccagaaggcccggaacgccctggacaacctcgcggtgctgcacaccgccgaggccgggggccgcgcctacaaccacgccctgagcgagctccccgagaccctggagacgctgctcctgctgaccctcctggcgaccgtgaccggcgggatcttcctgttcctcatgtccggcaaggggatcggcaagatgacgctggggatgtgctgcatcatcaccgccagcgtcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcaccgtggtggccgccacgatggccaacgagatgggcttcctggagaagaccaagaaggacctgggcctcgggagcatcaccacccaggagagcgagtccaacatcctggacatcgacctgcgcccggccagcgcgtggacgctctacgccgtcgccaccaccttcgtgacccccatgctgcggcactccatcgagaacagctccgtgaacgtcagcctgacggccatcgcgaaccaggccaccgtgctcatgggcctggggaagggctggcccctgtccaagatggacatcggggtgcccctcctggccatcggctgctacagccaggtcaacccgatcaccctgaccgccgccctcctgctgctcgtggcgcactacgccatcatcggccccgggctgcaggccaaggccacgcgcgaggcccagaagcgggcggccgccggcatcatgaagaaccccaccgtggacgggatcaccgtcatcgacctggagcccatcccgtacgaccccaagttcgagaagcagctcggccaggtgatgctgctgatcctctgcgtgacccaggtcctgatgatgcgcacgacctgggccctgtgcgaggccctcaccctggcgaccgggcccatctccacgctgtgggagggcaaccccggccggttctggaacaccaccatcgccgtgagcatggccaacatcttccgcgggtcctacctcgccggcgcggggctgctgttcagcatcatgaagaacaccacgaacacccgccggggcaccggcaacatcggggagaccctcggcgagaagtggaagtcccgcctgaacgccctgggcaagagcgagttccagatctacaagaagtccggcatccaggaggtggaccggacgctcgccaaggaggggatcaagcgcggcgagaccgaccaccacgccgtcagccggggctccgccaagctgcgctggttcgtggagcggaacatggtgaccccggaggggaaggtcgtggacctgggctgcgggcgcggcgggtggagctactactgcggcggcctcaagaacgtgcgggaggtcaaggggctgaccaagggcgggcccggccacgaggagcccatccccatgtccacgtacgggtggaacctggtgcgcctccagagcggcgtggacgtcttcttcaccccgcccgagaagtgcgacaccctgctgtgcgacatcggcgagagctcccccaaccccaccatcgaggcggggcggacgctccgcgtgctgaacctggtggagaactggctcaacaacaacacccagttctgcatcaaggtcctgaacccgtacatgcccagcgtgatcgagaagatggagaccctgcagcggaagtacggcggggccctcgtgcgcaaccccctgtcccggaacagcacccacgagatgtactgggtctccaacgccaccggcaacatcgtgagctccgtgaacatgatcagccgcatgctgatcaaccggttcacgatgaagcacaagaaggccacctacgagccggacgtcgacctggggtccggcacccgcaacatcggcatcgagagcgagatccccaacctcgacatcatcgggaagcggatcgagaagatcaagcaggagcacgagacctcctggcactacgaccaggaccacccctacaagacgtgggcctaccacggcagctacgagaccaagcagaccgggtccgcgagctccatggtgaacggcgtggtccgcctgctgaccaagccctgggacgtggtgccgatggtcacgcagatggccatgaccgacaccacccccttcggccagcagcgcgtgttcaaggagaaggtggacacgcggacccaggagcccaaggaggggaccaagaagctcatgaagatcaccgccgagtggctgtggaaggagctgggcaagaagaagacgccccgcatgtgcacccgggaggagttcacccgcaaggtccggagcaacgccgccctcggggcgatcttcaccgacgagaacaagtggaagtccgcccgcgaggccgtggaggacggccggttctgggagctggtcgaccgcgagcggaacctgcacctcgaggggaagtgcgagacgtgcgtgtacaacatgatgggcaagcgcgagaagaagctgggcgagttcgggaaggccaagggcagccgggcgatctggtacatgtggctgggggcccgcttcctcgagttcgaggccctgggcttcctgaacgaggaccactggttctcccgggggaacagcctcagcggcgtggagggcgaggggctgcaccgcctgggctacatcctccgggacgtcgggaagaaggagggcggggccatgtacgccgacgacaccgcgggctgggacacccgcatcaccctggaggacctgaagaacgaggagatggtgacgaaccacatgaagggcgagcacaagaagctcgccgaggccatcttcaagctgacctaccagaacaaggtggtccgggtgcagcgcccgacgccccgggggaccgtgatggacatcatctcccgcaaggaccagcggggcagcgggcaggtcggcacgtacggcctgaacaccttcaccaacatggaggcccagctcatccgccagatggagggggagggcatcttcaagtccatccagcacctgaccgccacggaggagatcgcggtgcagaactggctgacccgcgtggggcgggagcgcctcagccggatggccatctccggcgacgactgcgtcgtgaagcccatcgacgaccgcttcgccagcgccctgaccgccctgaacgacatggggaaggtgcggaaggacatccagcagtgggagccctcccgcggctggaacgactggacccaggtcccgttctgcagccaccacttccacgagctcgtgatgaaggacggccgggtgctggtcgtgccctgccgcaaccaggacgagctgatcgggcgggcgcgcatctcccagggcgccgggtggagcctcaaggagacggcctgcctgggcaagtcctacgcccagatgtggaccctgatgtacttccaccggcgcgacctccggctggccgcgaacgccatctgcagcgccgtgccctcccactgggtccccaccagccgcaccacctggtccatccacgccaagcacgagtggatgacgaccgaggacatgctggcggtgtggaaccgggtgtggatccaggagaacccgtggatggaggacaagacccccgtcgagagctgggaggaggtgccctacctcgggaagcgcgaggaccagtggtgcggctccctgatcggcctgaccagccgggccacgtgggccaagaacatccagaccgccatcaaccaggtgcgcagcctcatcgggaacgaggagtacaccgactacatgccctccatgaagcggttccgccgcgaggaggaggaggccggcgtcctgtggtga

SEQ ID NO: 9473 - RNA, 9876 nt, synthetic construct
  misc_feature 1..9876: note = derived and/or modified CDS sequence (opt1) from DENV-2__EU482608__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtcctgaagatcgtgcgcaacatggagaagtaccagctcgccgtgaccatcatggccatctcctgcgtcccgaacgccgtgatcctgcggaacgcctggaaggtgagctgcaccatcctggcggccgtctccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtcggcatggtgagcatcctcgcctccagcctgctgaagaacgacatccccatgaccgggcccctcgtggccggcgggctgctgaccgtctgctacgtgctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgcgggggtgtacaaggagggcacgttccacaccatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgcggtgagcctggacttctcccccggcaccagcgggtcccccatcgtcgaccgcaagggcaaggtggtggggctctacggcaacggcgtcgtgacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcacgctgatcctggccccgacccgggtggtggccgcggagatggaggaggccctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcgcacttcaccgaccccgcctccatcgccgcccggggctacatcagcacccgcgtcgagatgggggaggccgcgggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgcggggcccatgccggtgacccactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgcgatcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtggagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtcctgcacaccgccgaggcgggcgggcgggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcgcagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggccgcgaccatggccaacgagatggggttcctggagaagacgaagaaggacctgggcctcggcagcatcaccacccaggagagcgagtccaacatcctggacatcgacctgcggccggccagcgcctggaccctctacgccgtcgcgacgaccttcgtgacccccatgctgcgccactccatcgagaacagctccgtgaacgtcagcctgaccgccatcgccaaccaggccacggtgctcatggggctgggcaaggggtggcccctgtccaagatggacatcggcgtgcccctcctggcgatcgggtgctacagccaggtcaacccgatcaccctgaccgccgccctcctgctgctcgtggcccactacgccatcatcggccccggcctgcaggcgaaggccacccgggaggcccagaagcgcgccgccgcggggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcggaccacgtgggccctgtgcgaggccctcaccctggccaccggccccatctccaccctgtgggaggggaaccccggccgcttctggaacacgaccatcgccgtgagcatggcgaacatcttccgcggctcctacctcgccggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgcgaaggagggcatcaagcgcggggagacggaccaccacgccgtcagccgcggctccgccaagctgcggtggttcgtggagcgcaacatggtgaccccggagggcaaggtcgtggacctggggtgcggccgcggcgggtggagctactactgcggcgggctcaagaacgtgcgcgaggtcaaggggctgaccaagggcggccccgggcacgaggagcccatccccatgtccacctacggctggaacctggtgcggctccagagcggggtggacgtcttcttcacgccgcccgagaagtgcgacaccctgctgtgcgacatcggcgagagctcccccaaccccaccatcgaggccggccgcaccctccgggtgctgaacctggtggagaactggctcaacaacaacacccagttctgcatcaaggtcctgaacccgtacatgcccagcgtgatcgagaagatggagacgctgcagcgcaagtacgggggcgccctcgtgcggaaccccctgtcccgcaacagcacccacgagatgtactgggtctccaacgcgaccgggaacatcgtgagctccgtgaacatgatcagccggatgctgatcaaccgcttcaccatgaagcacaagaaggccacgtacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagcggctcatgcgcatcaccgcggagtggctgtggaaggagctggggaagaagaagacgccccggatgtgcacgcgcgaggagttcacccggaaggtccgcagcaacgccgccctcggcgccatcttcaccgacgagaacaagtggaagtccgcccgggaggcggtggaggacgggcgcttctgggagctggtggacaaggagcggaacctgcacctcgagggcaagtgcgagacctgcgtctacaacatgatggggaagcgcgagaagaagctgggcgagttcggcaaggccaaggggagccgggccatctggtacatgtggctgggcgcccgcttcctcgagttcgaggcgctggggttcctgaacgaggaccactggttctcccggggcaacagcctcagcggggtggagggcgagggcctgcaccgcctggggtacatcctccgggacgtcggcaagaaggagggcggcgccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagatcaaggtggtccgggtgcagcgcccgacgccccggggcaccgtgatggacatcatctcccgccgcgaccagcgggggagcggccaggtcgggacctacggcctgaacacgttcaccaacatggaggcccagctcatccgccagatggagggcgaggggatcttcaagtccatccagcacctgaccgccaccgaggagatcgccgtgcagaactggctggcccgggtgggccgcgagcggctcagccgcatggcgatctccggggacgactgcgtcgtgaagcccatcgacgaccggttcgccagcgccctgacggccctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcggccgcgcccggatctcccagggggcgggctggagcctcaaggagaccgcctgcctggggaagtcctacgcccagatgtggaccctgatgtacttccaccgccgggacctccgcctggccgccaacgcgatctgcagcgccgtgccctcccactgggtccccaccagccggacgacctggtccatccacgccaagcacgagtggatgaccaccgaggacatgctggccgtgtggaaccgcgtgtggatccaggagaacccgtggatggaggacaagacgcccgtcgagagctgggaggaggtgccctacctcggcaagcgggaggaccagtggtgcgggtccctgatcggcctgaccagccgcgcgacctgggccaagaacatccagaccgccatcaaccaggtgcgcagcctcatcggcaacgaggagtacacggactacatgccctccatgaagcggttccgccgggaggaggaggaggccggggtcctgtggtga

SEQ ID NO: 9474 - RNA, 9876 nt, synthetic construct
  misc_feature 1..9876: note = derived and/or modified CDS sequence (opt1) from DENV-2__EU687220__SS-prME
  source 1..9876: mol_type = other RNA
accgcgggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcgccatcatggcggccatcctggcctacaccatcgggaccacccacttccagaaggccctcatcttcatcctgctgaccgcggtggcccccagcatgaccatgcggtgcatcggcatctccaaccgcgacttcgtggagggcgtcagcgggggctcctgggtggacatcgtgctcgagcacgggagctgcgtcaccaccatggccaagaacaagcccaccctggacttcgagctgatcaagaccgaggccaagcagcccgccaccctccggaagtactgcatcgaggcgaagctgaccaacacgaccaccgagtcccgctgcccgacccagggcgagcccagcctgaacgaggagcaggacaagcggttcatctgcaagcactccatggtggaccgcggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccgccagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccggctccgcatggacaagctgcagctgaaggggatgtcctacagcatgtgcaccggcaagttcaagatcgtcaaggagatcgcggagacccagcacgggaccatcgtgatccgggtgcagtacgagggcgacggctccccctgcaagatccccttcgagatcatggacctcgagaagcgccacgtcctggggcggctgatcacggtgaacccgatcgtgaccgagaaggacagccccatcaacatcgaggccgagccgcccttcggcgactcctacatcatcatcggggtcgagccgggccagctcaagctgaactggttcaagaaggggagctccatcggccagatgttcgagaccaccatgcgcggcgccaagcgcatggccatcctgggggacacggcctgggacttcggcagcctcgggggcgtgttcacctccatcgggaaggcgctgcaccaggtgttcggcgccatctacggcgccgccttcagcggggtctcctggaccatgaagatcctgatcggcgtgatcatcacctggatcgggatgaacagccggtccacgagcctgtccgtgagcctcgtcctggtgggcgtggtcaccctgtacctcggggcgatggtgcaggccgactccggctgcgtggtcagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccgcagcgtgacccggctcgagaacctgatgtggaagcagatcacccccgagctgaaccacatcctctccgagaacgaggtcaagctgaccatcatgacgggcgacatcaaggggatcatgcaggcgggcaagcgcagcctgcggccgcagcccaccgagctcaagtactcctggaagacctggggcaaggccaagatgctgagcaccgagtcccacaaccagacgttcctgatcgacgggcccgagaccgccgagtgcccgaacaccaaccgcgcctggaacagcctcgaggtggaggactacggcttcggggtgttctccaccaacatctggctgaagctgcgggagaagcaggacgtcttctgcgacagcaagctcatgtccgccgcgatcaaggacaaccgcgccgtgcacgccgacatgggctactggatcgagagcgccctgaacgacacgtggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccggccgggctaccacacccagaccgccgggccctggcacctgggcaagctggagatggacttcgacttctgcgaggggaccacggtggtcgtgaccgaggactgcggcaaccgcggccccagcctccggaccaccacggcctccgggaagctgatcaccgagtggtgctgccgcagctgcaccctgcccccgctccggtaccgcggcgaggacgggtgctggtacggcatggagatccggcccctgaaggagaaggaggagaacctggtgaactccctcgtcaccgccgggcacggccagatcgacaacttcagcctgggcgtgctggggatggccctcttcctggaggagatgctgcgcacgcgggtgggcaccaagcacgccatcctcctggtcgccgtgtccttcgtgaccctgatcaccgggaacatgagcttccgcgacctcggccgggtcatggtgatggtgggggccacgatgaccgacgacatcggcatgggcgtcacctacctggccctgctcgcggccttcaaggtgcgccccaccttcgccgccgggctgctgctccgcaagctgacgtccaaggagctgatgatggccaccatcggcatcgcgctcctgagccagtccaccatccccgagaccatcctggagctcacggacgccctggccctggggatgatggtgctcaagatcgtccggaacatggagaagtaccagctggccgtgaccatcatggccatcagctgcgtgccgaacgcggtcatcctgctcaacgcctggaaggtgtcctgcaccatcctggccgccgtgagcgtcagccccctgctcctgaccagctcccagcagaaggcggactggatccccctggccctcacgatcaagggcctgaaccccaccgccatcttcctgaccaccctcagccgcacgtccaagaagcggagctggccgctgaacgaggccgtgatggccgtcggcatggtgtccatcctggcgagcagcctcctgaagaacgacatccccatgaccgggcccctggtggccggcgggctcctgaccgtctgctacgtgctgaccggccgctccgccgacctcgagctggagcgggccgccgacgtgaagtgggaggaccacgcggagatcagcgggtccagccccatcctgtccatcacgatcagcgaggacggctccatgagcatcaagaacgaggaggaggagcagaccctcaccatcctgatccgcaccggcctgctcgtcatctccggggtgttcccggtgagcatccccatcacggccgccgcctggtacctgtgggaggtcaagaagcagcgggccggcgtgctgtgggacgtgcccagcccgccgcccgtcgggaaggcggagctcgaggacggcgcctaccgcatcaagcagcgggggatcctgggctacagccagatcggcgccggggtgtacaaggagggcaccttccacaccatgtggcacgtgacccgcggggccgtcctgatgcaccggggcaagcgcatcgagccctcctgggccgacgtgaagaaggacctcatcagctacgggggcggctggaagctggagggggagtggaaggagggcgaggaggtgcaggtcctggcgctcgagcccgggaagaacccccgggccgtgcagaccaagcccggcctgttcaagacgaacaccgggaccatcggcgccgtgtccctggacttcagccccggcacctccgggagccccatcgtcgaccgcaagggcaaggtggtggggctctacggcaacggcgtcgtgacgcggtccggggcctacgtgagcgcgatcgcccagaccgagaagtccatcgaggacaaccccgagatcgaggacgacatcttccgcaagaagcggctgaccatcatggacctgcaccccggcgccgggaagaccaagcgctacctgcccgccatcgtccgggaggccatcaagcgcggcctccggacgctgatcctggcgccgacccgcgtggtggccgccgagatggaggaggccctccgcgggctgcccatccggtaccagacccccgccatccgcgcggagcacaccggccgggagatcgtcgacctgatgtgccacgccacgttcaccatgcgcctcctgtcccccgtgcgggtgccgaactacaacctgatcatcatggacgaggcccacttcaccgaccccgccagcatcgccgcgcgcggctacatctccacccgggtcgagatgggggaggccgccggcatcttcatgacggccacgccgcccgggagccgcgacccgttcccccagtccaacgcgcccatcatggacgaggagcgggagatccccgagcgcagctggaactccggccacgagtgggtgaccgacttcaaggggaagaccgtgtggttcgtcccgagcatcaaggccggcaacgacatcgccgcctgcctccggaagaacggcaagaaggtgatccagctgtcccgcaagacgttcgacagcgagtacgtgaagacccgggccaacgactgggacttcgtcgtgaccaccgacatctccgagatgggggcgaacttccgcgccgagcgggtgatcgacccccgccggtgcatgaagcccgtcatcctgacggacggcgaggagcgcgtgatcctcgccgggcccatgccggtgacccacagctccgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacccccgagggcatcatcccgagcatgttcgagcccgagcgcgagaaggtcgacgccatcgacggggagtaccggctgcgcggcgaggcccggaagaccttcgtggacctgatgcgccgcggggacctccccgtgtggctggcctaccgcgtcgcggccgagggcatcaactacgccgaccggcgctggtgcttcgacgggatcaagaacaaccagatcctggaggagaacgtggaggtggagatctggacgaaggagggcgagcggaagaagctcaagccgcgctggctggacgcccggatctactccgaccccctggcgctcaaggagttcaaggagttcgccgccggccgcaagagcctgaccctgaacctcatcaccgagatggggcggctgcccaccttcatgacgcagaaggcccgcgacgccctggacaacctcgcggtcctgcacaccgccgaggccggcgggcgggcctacaaccacgccctgtccgagctccccgagaccctggagaccctgctcctgctgacgctcctggcgaccgtgaccggcggcatcttcctgttcctcatgagcgggaagggcatcgggaagatgaccctgggcatgtgctgcatcatcacggcctccatcctgctctggtacgcccagatccagccgcactggatcgccgccagcatcatcctggagttcttcctgatcgtcctcctgatccccgagcccgagaagcagcgcacgccccaggacaaccagctgacctacgtggtgatcgcgatcctcaccgtcgtggccgccaccatggccaacgagatggggttcctggagaagacgaagaaggacctgggcctcggcagcatcaccacccaggagtccgagagcaacatcctggacatcgacctgcggccggcctccgcgtggaccctctacgccgtggccacgaccttcgtcacccccatgctgcgccacagcatcgagaactccagcgtgaacgtgtccctgaccgccatcgcgaaccaggccacggtcctcatggggctgggcaaggggtggcccctgagcaagatggacatcggcgtgcccctcctggccatcgggtgctactcccaggtgaacccgatcaccctgaccgccgccctcctgctgctcgtcgcgcactacgccatcatcggccccggcctgcaggccaaggccacccgggaggcccagaagcgcgcggccgccgggatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcgcaccacgtgggccctgtgcgaggccctcaccctggcgaccggccccatcagcaccctgtgggaggggaaccccggccggttctggaacacgaccatcgccgtctccatggccaacatcttccgcggcagctacctcgccggggcgggcctgctgttctccatcatgaagaacaccaccaacacgcggcgcgggaccggcaacatcggcgagaccctcggggagaagtggaagtcccggctgaacgccctgggcaagtccgagttccagatctacaagaagtccgggatccaggaggtggaccgcaccctcgccaaggagggcatcaagcgcggggagacggaccaccacgccgtgtcccgcggcagcgccaagctgcggtggttcgtcgagcgcaacatggtgaccccggagggcaaggtggtcgacctggggtgcggccgcggcgggtggtcctactactgcggcgggctcaagaacgtgcgcgaggtgaaggggctgaccaagggcgggcccgggcacgaggagcccatccccatgagcacctacggctggaacctggtccggctccagagcggggtggacgtgttcttcacgccgcccgagaagtgcgacaccctgctgtgcgacatcggcgagtccagccccaaccccaccatcgaggcgggccgcaccctccgggtcctgaacctggtggagaactggctcaacaacaacacgcagttctgcatcaaggtgctgaacccgtacatgccctccgtcatcgagaagatggagaccctgcagcgcaagtacgggggcgccctggtgcggaaccccctcagccgcaactccacccacgagatgtactgggtgagcaacgccaccgggaacatcgtctccagcgtgaacatgatctcccggatgctgatcaaccgcttcaccatgaagcacaagaaggccacgtacgagccggacgtggacctgggcagcgggacccgcaacatcggcatcgagtccgagatccccaacctcgacatcatcggcaagcggatcgagaagatcaagcaggagcacgagaccagctggcactacgaccaggaccacccctacaagacctgggcctaccacgggtcctacgagacgaagcagaccggcagcgcgtccagcatggtcaacggggtggtgcgcctgctgaccaagccctgggacgtcgtgccgatggtgacccagatggccatgacggacaccacccccttcggccagcagcgggtcttcaaggagaaggtggacacccgcacgcaggagcccaaggagggcaccaagaagctcatgcggatcaccgccgagtggctgtggaaggagctggggaagaagaagacgccccggatgtgcacgcgggaggagttcacccgcaaggtgcggtccaacgccgccctcggcgcgatcttcaccgacgagaacaagtggaagtccgcccgcgaggccgtcgaggactcccggttctgggagctggtggaccgcgagcggaacctgcacctcgaggggaagtgcgagacctgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttcagccgggggaactccctcagcggcgtcgagggggagggcctgcaccgcctgggctacatcctccgggacgtgtccaagaaggagggcggggccatgtacgccgacgacacggcggggtgggacacccgcatcaccctggaggacctgaagaacgaggagatggtcaccaaccacatgaagggcgagcacaagaagctcgccgaggccatcttcaagctgacgtaccagaacaaggtggtgcgggtccagcgcccgacgccccgggggaccgtgatggacatcatcagccggcgcgaccagcggggctccggccaggtggggacctacggcctgaacacgttcaccaacatggaggcccagctcatccgccagatggagggggagggcatcttcaagagcatccagcacctgaccgtcaccgaggagatcgccgtgcagaactggctggtgcgggtcggccgcgagcggctctcccgcatggcgatcagcggggacgactgcgtggtgaagcccctggacgaccggttcgcctccgccctgacggccctcaacgacatgggcaaggtccgcaaggacatccagcagtgggagcccagccgggggtggaacgactggacccaggtgccgttctgctcccaccacttccacgagctggtgatgaaggacggccgcgtcctggtggtgccctgccggaaccaggacgagctcatcgggcgcgcccggatcagccagggcgcgggctggtccctgaaggagaccgcctgcctgggcaagagctacgcccagatgtggaccctcatgtacttccaccgccgggacctgcgcctggccgccaacgcgatctgctccgccgtccccagccactgggtgcccacgtcccggaccacctggagcatccacgccaagcacgagtggatgaccaccgaggacatgctcgccgtgtggaaccgcgtctggatccaggagaacccgtggatggaggacaagacgcccgtggagagctgggaggaggtgccctacctgggcaagcgcgaggaccagtggtgcgggtccctgatcggcctcaccagccgggcgacctgggccaagaacatccagaccgccatcaaccaggtccgctccctgatcgggaacgaggagtacacggactacatgcccagcatgaagcggttccgccgggaggaggaggaggccggcgtgctgtggtga

SEQ ID NO: 9475 - RNA, 9876 nt, synthetic construct
  misc_feature 1..9876: note = derived and/or modified CDS sequence (opt1) from DENV-2__EU726775__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacttctgcgaggggaccaccgtggtggtcacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacccgcgtgggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggggaaggccgagctggaggacggcgcgtaccggatcaagcagcgcgggatcctgggctactcccagatcggcgccggggtgtacaaggagggcaccttccacacgatgtggcacgtcacccgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgcggtgcagaccaagcccggcatcttccggaccaacacggggaccatcggcgccatcagcctggacttctcccccggcaccagcgggtcccccatcgtcgaccgcaagggcaaggtggtggggctctacggcaacggcgtcgtgacccggagcggggcctacgtgtccgccatcgcgcagacggagaagtccatcgaggacaaccccgagatcgaggacgacatcttccgcaagaagcggctgaccatcatggacctgcaccccggcgccgggaagaccaagcgctacctccccgccatcgtccgggaggccatcaagcgcggcctgcgcaccctgatcctggccccgacgcgggtggtggcggccgagatggaggaggccctccgcgggctgcccatccggtaccagacccccgccatcaaggccgagcacaccggccgcgagatcgtcgacctgatgtgccacgcgaccttcacgatgcggctcctgagccccgtgcgcgtgccgaactacaacctgatcatcatggacgaggcccacttcaccgaccccgcctccatcgccgcccggggctacatcagcacccgcgtcgagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggcgggcaacgacatcgccgcctgcctccgcaagaacggcaagaaggtgatccagctgagccggaagaccttcgactccgagtacgtgaagacgcgcgccaacgactgggacttcgtcgtgaccaccgacatcagcgagatgggggccaacttcaaggcggagcgggtgatcgacccccgccggtgcatgaagcccgtcatcctgaccgacggcgaggagcgcgtgatcctcgccgggcccatgccggtgacgcactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgcgagaaggtcgacgccatcgacggggagtaccggctgcgcggcgaggcccggaagaccttcgtggacctgatgcgccgcggggacctccccgtgtggctggcctacaaggtcgccgcggagggcatcaactacgccgaccgcaagtggtgcttcgacgggatcaagaacaaccagatcctggaggagaacgtggaggtggagatctggaccaaggagggcgagcggaagaagctcaagccgcgctggctggacgcccggatctacagcgaccccctggccctcaaggagttcaaggagttcgcggccggccgcaagtccctgacgctgaacctcatcaccgagatggggcggctgcccaccttcatgacccagaaggcccgcaacgccctggacaacctcgccgtcctgcacacggcggaggccggcgggcgggcctacaaccacgccctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtcctcctgatccccgagcccgagaagcagcgcacgccccaggacaaccagctgacgtacgtggtgatcgccatcctcaccgtcgtggcggccaccatggccaacgagatggggttcctggagaagaccaagaaggacctgggcctcggcagcatcacgacccaggagagcgagtccaacatcctggacatcgacctgcggccggccagcgcctggaccctctacgcggtggccaccacgttcgtcacccccatgctgcgccactccatcgagaacagctccgtgaacgtgagcctgaccgccatcgccaaccaggcgaccgtcctcatggggctgggcaaggggtggcccctgtccaagatggacatcggcgtgcccctcctggccatcgggtgctacagccaggtgaacccgatcacgctgaccgccgccctcctgctgctcgtcgcccactacgcgatcatcggccccggcctgcaggccaaggccacccgggaggcccagaagcgcgccgcggccgggatcatgaagaaccccaccgtggacggcatcacggtgatcgacctggagcccatcccgtacgaccccaagttcgagaagcagctcgggcaggtcatgctgctgatcctctgcgtgacccaggtgctgatgatgcggaccacctgggccctgtgcgaggccctcacgctggccaccggccccatctccaccctgtgggaggggaaccccggccgcttctggaacaccacgatcgcggtcagcatggccaacatcttccgcggctcctacctcgccggggccggcctgctgttcagcatcatgaagaacaccaccaacacccggcgcgggacgggcaacatcggcgagaccctcggggagaagtggaagtcccggctgaacgcgctgggcaagagcgagttccagatctacaagaagtccgggatccaggaggtggaccgcaccctcgccaaggagggcatcaagcgcggggagaccgaccaccacgccgtgagccgcggctccgccaagctgcggtggttcgtcgagcgcaacatggtgacgccggagggcaaggtggtcgacctggggtgcggccgcgggggctggagctactactgcgggggcctcaagaacgtgcgcgaggtgaagggcctgaccaagggcggccccgggcacgaggagcccatccccatgtccacctacggctggaacctggtccggctccagagcggggtggacgtgttcttcaccccgcccgagaagtgcgacacgctgctgtgcgacatcggcgagagctcccccaaccccaccatcgaggccggccgcaccctccgggtcctgaacctggtggagaactggctcaacaacaacacccagttctgcatcaaggtgctgaacccgtacatgcccagcgtcatcgagaagatggagaccctgcagcgcaagtacgggggcgcgctcgtgcggaaccccctgtcccgcaacagcacgcacgagatgtactgggtgtccaacgccaccgggaacatcgtcagctccgtgaacatgatcagccggatgctgatcaaccgcttcaccatgaagcacaagaaggccacctacgagccggacgtggacctgggctccgggacgcggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagaccaagcagacgggctccgccagctccatggtcaacggggtggtgcgcctgctgaccaagccctgggacgtcgtgccgatggtgacccagatggcgatgaccgacacgacccccttcggccagcagcgggtcttcaaggagaaggtggacacccgcacccaggagcccaaggagggcacgaagaagctcatgaagatcaccgccgagtggctgtggaaggagctggggaagaagaagacgccccggatgtgcacccgcgaggagttcacgcggaaggtgcgcagcaacgccgccctcggcgccatcttcaccgacgagaacaagtggaagtccgcgcgggaggccgtcgaggacgggcgcttctgggagctggtggaccgggagcgcaacctgcacctcgagggcaagtgcgagacctgcgtgtacaacatgatggggaagcgggagaagaagctgggcgagttcggcaaggccaaggggagccgcgccatctggtacatgtggctgggcgcgcggttcctcgagttcgaggccctggggttcctgaacgaggaccactggttctcccgcggcaacagcctcagcggggtcgagggcgagggcctgcaccggctggggtacatcctccgcgacgtgggcaagaaggagggcggcgccatgtacgccgacgacaccgccgggtgggacacgcggatcaccctggaggacctgaagaacgaggagatggtcaccaaccacatgaagggcgagcacaagaagctcgcggaggccatcttcaagctgacctaccagaacaaggtggtgcgcgtccagcggccgacgccccgcggcaccgtgatggacatcatctcccggcgcgaccagcgcgggagcggccaggtggggacctacggcctgaacaccttcacgaacatggaggcccagctcatccggcagatggagggcgaggggatcttccgctccatccagcacctgaccgccaccgaggagatcgccgtccagaactggctggcgcgggtgggccgcgagcggctcagccgcatggccatctccggggacgactgcgtggtcaagcccatcgacgaccggttcgccagcgccctgaccgccctgaacgacatgggcaaggtgcgcaaggacatccagcagtgggagccctcccgggggtggaacgactggacccaggtcccgttctgcagccaccacttccacgagctcgtcatgaaggacggccgcgtgctggtggtcccctgccggaaccaggacgagctgatcggccgcgcgcggatctcccagggggccggctggagcctcaaggagaccgcctgcctggggaagtcctacgcccagatgtggaccctgatgtacttccaccgccgggacctccgcctggccgcgaacgccatctgcagcgccgtgccctcccactgggtgcccaccagccggaccacgtggtccatccacgccaagcacgagtggatgaccaccgaggacatgctggcggtctggaaccgcgtgtggatccaggagaacccgtggatggaggacaagacccccgtggagagctgggaggaggtcccctacctcggcaagcgggaggaccagtggtgcgggtccctgatcggcctgacgagccgcgccacctgggccaagaacatccagaccgccatcaaccaggtgcgcagcctcatcggcaacgaggagtacaccgactacatgccctccatgaagcggttccgccgggaggaggaggaggccggggtgctgtggtga

SEQ ID NO: 9476 - RNA, 9876 nt, synthetic construct
  misc_feature 1..9876: note = derived and/or modified CDS sequence (opt1) from DENV-2__FJ639732__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccgtgaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtcctgaagatcgtgcgcaacatggagaagtaccagctcgccgtgaccatcatggccatctcctgcgtcccgaacgccgtgatcctgcggaacgcctggaaggtcagctgcaccatcctggcggccgtgtccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtcggcatggtgagcatcctcgcctccagcctgctgaagaacgacatccccatgaccgggcccctcgtggccggcgggctgctgaccgtctgctacgtgctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgcgggggtgtacaaggagggcacgttccacaccatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgcggtgagcctggacttctcccccggcaccagcgggtcccccatcgtcgaccgcaagggcaaggtggtggggctctacggcaacggcgtcgtgacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcacgctgatcctggccccgacccgggtggtggccgcggagatggaggaggccctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcgcacttcaccgaccccgcctccatcgccgcccggggctacatcagcacccgcgtcgagatgggggaggccgcgggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgcggggcccatgccggtgacccactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgcgatcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtcgagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtgctgcacaccgccgaggcgggcgggcgggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcgcagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggccgcgaccatggccaacgagatggggttcctggagaagacgaagaaggacctgggcctcggcagcatcaccacccaggagagcgagtccaacatcctggacatcgacctgcggccggccagcgcctggaccctctacgccgtcgcgacgaccttcgtgacccccatgctgcgccactccatcgagaacagctccgtgaacgtcagcctgaccgccatcgccaaccaggccacggtgctcatggggctgggcaaggggtggcccctgtccaagatggacatcggcgtgcccctcctggcgatcgggtgctacagccaggtcaacccgatcaccctgaccgccgccctcctgctgctcgtggcccactacgccatcatcggccccggcctgcaggcgaaggccacccgggaggcccagaagcgcgccgccgcggggatcatgaagaaccccacggtggacggcatcaccgtcatcgacctggagcccatcccgtacgaccccaagttcgagaagcagctcgggcaggtcatgctgctgatcctctgcgtgacccaggtcctgatgatgcggaccacgtgggccctgtgcgaggccctcaccctggccaccggccccatctccaccctgtgggaggggaaccccggccgcttctggaacacgaccatcgccgtgagcatggcgaacatcttccgcggctcctacctcgccggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgcgaaggagggcatcaagcgcggggagacggaccaccacgccgtcagccgcggctccgccaagctgcggtggttcgtggagcgcaacatggtgaccccggagggcaaggtcgtggacctggggtgcggccgcgggggctggagctactactgcgggggcctcaagaacgtgcgcgaggtcaagggcctgaccaagggcggccccgggcacgaggagcccatccccatgtccacctacggctggaacctggtgcggctccagagcggggtggacgtcttcttcacgccgcccgagaagtgcgacaccctgctgtgcgacatcggcgagagctcccccaaccccaccatcgaggccggccgcaccctccgggtgctgaacctggtggagaactggctcaacaacaacacccagttctgcatcaaggtcctgaacccgtacatgcccagcgtgatcgagaagatggagacgctgcagcgcaagtacgggggcgccctcgtgcggaaccccctgtcccgcaacagcacccacgagatgtactgggtctccaacgcgaccgggaacatcgtgagctccgtgaacatgatcagccggatgctgatcaaccgcttcaccatgaagcacaagaaggccacgtacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgcggagtggctgtggaaggagctggggaagaagaagacgccccggatgtgcacgcgggaggagttcacccgcaaggtccggagcaacgccgccctcggcgccatcttcaccgacgagaacaagtggaagtccgcccgcgaggcggtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggagccgggccatctggtacatgtggctgggcgcccgcttcctcgagttcgaggcgctggggttcctgaacgaggaccactggttctcccggggcaacagcctcagcggggtggagggcgagggcctgcaccgcctggggtacatcctccgggacgtcggcaagaaggagggcggcgccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagaacaaggtggtccgggtgcagcgcccgacgccccggggcaccgtgatggacatcatctcccgccgcgaccagcgggggagcggccaggtcgggacctacggcctgaacacgttcaccaacatggaggcccagctcatccgccagatggagggcgaggggatcttcaagtccatccagcacctgaccgccaccgaggagatcgccgtgcagaactggctggcccgggtgggccgcgagcggctcagccgcatggcgatctccggggacgactgcgtcgtgaagcccatcgacgaccggttcgccagcgccctgacggccctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcggccgcgcccggatctcccagggggcgggctggagcctcaaggagaccgcctgcctggggaagtcctacgcccagatgtggaccctgatgtacttccaccgccgggacctccgcctggccgccaacgcgatctgcagcgccgtgccctcccactgggtccccaccagccggacgacctggtccatccacgccaagcacgagtggatgaccaccgaggacatgctggccgtgtggaaccgcgtgtggatccaggagaacccgtggatggaggacaagacgcccgtcgagagctgggaggaggtgccctacctcggcaagcgggaggaccagtggtgcgggtccctgatcggcctgaccagccgcgcgacctgggccaagaacatccagaccgccatcaaccaggtgcgcagcctcatcggcaacgaggagtacacggactacatgccctccatgaagcggttccgccgggaggaggaggaggccggggtcctgtggtga

SEQ ID NO: 9477 - RNA, 9876 nt, synthetic construct
  misc_feature 1..9876: note = derived and/or modified CDS sequence (opt1) from DENV-2__FJ639733__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgatcgagaaggacagccccgtcaacatcgaggcggagccgcccttcggcgactcctacatcatcatcggggtggagccgggccagctgaagctcaactggttcaagaaggggagctccatcggccagatgttcgaggccaccatgcgcggcgccaagcggatggccatcctgggggacacggcctgggacttcggcagcctcggcggggcgttcacctccatcgggaaggccctccaccaggtgttcggggccatctacggcgccgcgttcagcggggtctcctggaccatgaagatcctgatcggcgtggtgatcacctggatcgggatgaacagccgctccacgagcctgtccgtcagcctggtgctcgtgggcgtcgtgaccctgtacctgggggccatggtgcaggccgactccggctgcgtcgtgagctggaagaacaaggagctcaagtgcggctccgggatcttcatcaccgacaacgtgcacacctggacggagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcaccatcatgacgggcgacaccaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacccagacggccgggccctggcacctcggcaagctggagatggacttcgacttctgcgaggggaccaccgtcgtggtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgcggggcacggccagatcgacaacttctccctcggcgtgctggggatggccctgttcctcgaggagatgctgcggacccgcgtcggcaccaagcacgccatcctgctcgtggccgtgagcttcgtcacgctgatcaccgggaacatgtccttccgggacctgggccgcgtgatggtgatggtcggggccaccatgaccgacgacatcggcatgggcgtgacgtacctcgcgctgctggccgccttcaaggtgcgccccaccttcgccgccgggctcctgctgcggaagctcaccagcaaggagctgatgatggcgaccatcggcatcacgctgctctcccagagcaccatccccgagaccatcctggagctgaccgacgccctcgccctggggatgatggtcctgaagatcgtgcgcaagatggagaagtaccagctcgccgtgacgatcatggccatctcctgcgtcccgaacgcggtgatcctgcggaacgcctggaaggtgagctgcaccatcctggccgccgtctccgtgagccccctcctgctgacctccagccagcagaaggcggactggatccccctcgccctgaccatcaagggcctgaaccccacggccatcttcctcaccaccctgtcccgcaccagcaagaagcggtcctggccgctgaacgaggccatcatggccgtcggcatggtgagcatcctcgcgtccagcctgctgaagaacgacatccccatgacggggcccctcgtggccggcgggctgctgaccgtctgctacgtgctcaccggccgcagcgccgacctggagctggagcgggccgccgacgtgaagtgggaggaccaggcggagatctccgggagctcccccatcctcagcatcaccatctccgaggacggcagcatgtccatcaagaacgaggaggaggagcagacgctgaccatcctgatccgcaccggcctcctggtcatcagcggggtgttcccggtgtccatccccatcaccgccgccgcctggtacctgtgggaggtcaagaagcagcgggccggcgtgctctgggacgtgcccagcccgccgcccgtcgggaaggcggagctggaggacggcgcctaccgcatcaagcagcgggggatcctgggctactcccagatcggcgccggggtgtacaaggagggcaccttccacacgatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgcgctggagcccgggaagaacccccgggccgtgcagaccaagcccggcatcttcaagaccaacacggggaccatcggcgccgtgagcctggacttctcccccggcaccagcgggtcccccatcgtcgaccgcaagggcaaggtggtggggctctacggcaacggcgtcgtgacccggagcggggcctacgtgtccgcgatcgcccagacggagaagtccatcgaggacaaccccgagatcgaggacgacatcttccgcaagaagcggctgaccatcatggacctgcaccccggcgccgggaagaccaagcgctacctccccgccatcgtccgggaggccatcaagcgcggcctgcgcaccctgatcctggcgccgacgcgggtggtggccgccgagatggaggaggccctccgcgggctgcccatccggtaccagacccccgccatcaaggcggagcacaccggccgcgagatcgtcgacctgatgtgccacgccaccttcacgatgcggctcctgagccccgtgcgcgtgccgaactacaacctgatcatcatggacgaggcccacttcaccgaccccgcctccatcgccgcgcggggctacatcagcacccgcgtcgagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgaccgacttcaaggggaagaccgtgtggttcgtcccgtccatcaaggccggcaacgacatcgccgcctgcctccgcaagaacggcaagaaggtgatccagctgagccggaagaccttcgactccgagtacgtgaagacgcgcgccaacgactgggacttcgtcgtgaccaccgacatcagcgagatgggggcgaacttcaaggccgagcgggtgatcgacccccgccggtgcatgaagcccgtcatcctgaccgacggcgaggagcgcgtgatcctcgccgggcccatgccggtgacgcactccagcgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgcgagaaggtcgacgccatcgacggggagtaccggctgcgcggcgaggcccggaagaccttcgtggacctgatgcgccgcggggacctccccgtgtggctggcctacaaggtcgcggccgagggcatcaactacgccgaccgcaagtggtgcttcgacgggatcaagaacaaccagatcctggaggagaacgtggaggtggagatctggaccaaggagggcgagcggaagaagctcaagccgcgctggctggacgcccggatctacagcgaccccctggcgctcaaggagttcaaggagttcgccgccggccgcaagtccctgacgctgaacctcatcaccgagatggggcggctgcccaccttcatgacccagaaggcccgcaacgccctggacaacctcgcggtcctgcacacggccgaggccggcgggcgggcctacaaccacgccctgagcgagctccccgagaccctggagaccctgctcctgctgaccctcctggcgacggtgaccggcggcatcttcctgttcctcatgtccgggaagggcatcgggaagatgaccctgggcatgtgctgcatcatcaccgccagcgtcctgctctggtacgcccagatccagccgcactggatcgccgcctccatcatcctggagttcttcctgatcgtgctcctgatccccgagcccgagaagcagcgcacgccccaggacaaccagctgacgtacgtggtcatcgcgatcctcaccgtggtggccgccaccatggccaacgagatggggttcctggagaagaccaagaaggacctgggcctcggcagcatcacgacccaggagagcgagtccaacatcctggacatcgacctgcggccggccagcgcgtggaccctctacgccgtcgccaccacgttcgtgacccccatgctgcgccactccatcgagaacagctccgtgaacgtcagcctgaccgccatcgcgaaccaggccaccgtgctcatggggctgggcaaggggtggcccctgtccaagatggacatcggcgtgcccctcctggccatcgggtgctacagccaggtcaacccgatcacgctgaccgccgccctcctgctgctcgtggcgcactacgccatcatcggccccggcctgcaggccaaggccacccgggaggcccagaagcgcgcggccgccgggatcatgaagaaccccaccgtggacggcatcacggtcatcgacctggagcccatcccgtacgaccccaagttcgagaagcagctcggccaggtgatgctgctgatcctctgcgtgacccaggtcctgatgatgcggaccacctgggccctgtgcgaggccctcacgctggcgaccggccccatctccaccctgtgggaggggaaccccggccgcttctggaacaccacgatcgccgtgagcatggccaacatcttccgcggctcctacctcgccggggcgggcctgctgttcagcatcatgaagaacaccaccaacacccggcgcgggacgggcaacatcggcgagaccctcggggagaagtggaagtcccggctgaacgccctgggcaagagcgagttccagatctacaagaagtccgggatccaggaggtggaccgcaccctcgccaaggagggcatcaagcgcggggagaccgaccaccacgccgtcagccgcggctccgccaagctgcggtggttcgtggagcgcaacatggtgacgccggagggcaaggtcgtggacctggggtgcggccgcggcgggtggagctactactgcggcgggctcaagaacgtgcgcgaggtcaaggggctgaccaagggcggccccgggcacgaggagcccatccccatgtccacctacggctggaacctggtgcggctccagagcggggtggacgtcttcttcaccccgcccgagaagtgcgacacgctgctgtgcgacatcggcgagagctcccccaaccccaccatcgaggcgggccgcaccctccgggtgctgaacctggtggagaactggctcaacaacaacacccagttctgcatcaaggtcctgaacccgtacatgcccagcgtgatcgagaagatggagaccctgcagcgcaagtacgggggcgccctcgtgcggaaccccctgtcccgcaacagcacgcacgagatgtactgggtctccaacgccaccgggaacatcgtgagctccgtgaacatgatcagccggatgctgatcaaccgcttcaccatgaagcacaagaaggccacctacgagccggacgtcgacctgggctccgggacgcggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagaccaagcagacgggctccgcgagctccatggtgaacggggtggtccgcctgctgaccaagccctgggacgtggtgccgatggtcacccagatggccatgaccgacacgacccccttcggccagcagcgggtgttcaaggagaaggtggacacccgcacccaggagcccaaggagggcacgaagaagctcatgcggatcaccgccgagtggctgtggaaggagctggggaagaagaagacgccccggatgtgcacccgggaggagttcacgcgcaaggtccggagcaacgccgccctcggcgcgatcttcaccgacgagaacaagtggaagtccgcccgcgaggccgtggaggacgggcggttctgggagctggtggacaaggagcgcaacctgcacctcgagggcaagtgcgagacctgcgtctacaacatgatggggaagcgggagaagaagctgggcgagttcggcaaggccaaggggagccgcgcgatctggtacatgtggctgggcgcccggttcctcgagttcgaggccctggggttcctgaacgaggaccactggttctcccgcggcaacagcctcagcggggtggagggcgagggcctgcaccggctggggtacatcctccgcgacgtcggcaagaaggagggcggcgccatgtacgccgacgacaccgcggggtgggacacgcggatcaccctggaggacctgaagaacgaggagatggtgaccaaccacatgaagggcgagcacaagaagctcgccgaggccatcttcaagctgacctaccagaacaaggtggtccgcgtgcagcggccgacgccccgcggcaccgtgatggacatcatctcccggcgcgaccagcgcgggagcggccaggtcgggacctacggcctgaacaccttcacgaacatggaggcccagctcatccggcagatggagggcgaggggatcttcaagtccatccagcacctgaccgccaccgaggagatcgcggtgcagaactggctggcccgcgtgggccgggagcgcctcagccggatggccatctccggggacgactgcgtcgtgaagcccatcgacgaccgcttcgccagcgccctgaccgcgctgaacgacatgggcaaggtgcggaaggacatccagcagtgggagccctcccgcgggtggaacgactggacgcaggtcccgttctgcagccaccacttccacgagctcgtgatgaaggacggccgggtgctggtcgtgccctgccgcaaccaggacgagctgatcggccgggcccgcatctcccagggggccggctggagcctcaaggagaccgcctgcctggggaagtcctacgcccagatgtggaccctgatgtacttccaccggcgcgacctccggctggcggccaacgccatctgcagcgccgtgccctcccactgggtccccaccagccgcaccacgtggtccatccacgcgaagcacgagtggatgaccaccgaggacatgctggccgtgtggaaccgggtgtggatccaggagaacccgtggatggaggacaagacccccgtcgagagctgggaggaggtgccctacctcggcaagcgcgaggaccagtggtgcgggtccctgatcggcctgacgagccgggccacctgggccaagaacatccagaccgccatcaaccaggtgcgcagcctcatcggcaacgaggagtacaccgactacatgccctccatgaagcgcttccggcgcgaggaggaggaggcgggggtcctgtggtga

SEQ ID NO: 9478 - RNA, 9876 nt, synthetic construct
  misc_feature 1..9876: note = derived and/or modified CDS sequence (opt1) from DENV-2__FJ639734__SS-prME
  source 1..9876: mol_type = other RNA
accgccggcgtgatcgtcatgctgatccccaccgccatcgcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcgtgatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacaccaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgcggggccctggcacctcggcaagctggagatggacttcgacctgtgcgaggggaccacggtggtcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacgcgcgtgggcaccaagcacgcgatcctcctggtcgccgtgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccatccccgagaccatcctggagctcacggacgcgctggccctggggatgatggtgctcaagatcgtccgcaacatggagaagtaccagctggccgtgaccatcatggccatctcctgcgtgccgaacgccgtcatcctgcggaacgcgtggaaggtgagctgcaccatcctcgccgccgtctccgtgagccccctgctgctcacctccagccagcagaaggccgactggatccccctggcgctgacgatcaagggcctcaaccccaccgccatcttcctgaccaccctgtcccgcacgagcaagaagcggtcctggccgctcaacgaggccatcatggccgtgggcatggtcagcatcctggcctccagcctgctcaagaacgacatccccatgaccgggcccctggtggcgggcgggctgctcaccgtgtgctacgtcctgaccggccgcagcgccgacctggagctcgagcgggccgccgaggtgaagtgggaggaccaggccgagatctccgggagctcccccatcctgagcatcacgatctccgaggacggcagcatgtccatcaagaacgaggaggaggagcagaccctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggggaaggccgagctggaggacggcgcgtaccgcatcaagcagcgggggatcctcggctactcccagatcggcgccggggtctacaaggagggcacgttccacaccatgtggcacgtgacccgcggggccgtgctgatgcaccggggcaagcgcatcgagcccagctgggccgacgtcaagaaggacctgatctcctacgggggcggctggaagctcgagggggagtggaaggagggcgaggaggtccaggtgctggccctggagcccgggaagaacccccgggcggtccagaccaagcccggcatcttcaagacgaacaccgggaccatcggcgccgtgagcctcgacttctcccccggcaccagcgggtcccccatcgtggaccgcaagggcaaggtcgtggggctgtacggcaacggcgtggtcacgcggagcggggcctacgtgtccgccatcgcgcagaccgagaagtccatcgaggacaaccccgagatcgaggacgacatcttccgcaagaagcggctgaccatcatggacctccaccccggcgccgggaagaccaagcgctacctgcccgccatcgtgcgggaggccatcaagcgcggcctgcgcacgctgatcctcgccccgacccgggtcgtggcggccgagatggaggaggccctgcgcgggctgcccatccggtaccagacccccgccatcaaggccgagcacaccggccgcgagatcgtggacctcatgtgccacgcgacgttcaccatgcggctgctgagccccgtccgcgtgccgaactacaacctcatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctgcgcaagaacggcaagaaggtcatccagctgagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctcacggacggcgaggagcgcgtcatcctggccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgtccatgttcgagcccgagcgcgagaaggtggacgccatcgacggggagtaccggctgcgcggcgaggcccggaagaccttcgtcgacctcatgcgccgcggggacctgcccgtgtggctggcctacaaggtggccgcggagggcatcaactacgccgaccgcaagtggtgcttcgacgggatcaagaacaaccagatcctcgaggagaacgtcgaggtggagatctggacgaaggagggcgagcggaagaagctgaagccgcgctggctggacgcccggatctacagcgaccccctcgccctgaaggagttcaaggagttcgcggccggccgcaagtccctgaccctcaacctgatcaccgagatggggcggctgcccaccttcatgacgcagaaggcccgcaacgccctcgacaacctggccgtcctgcacaccgcggaggccggcgggcgggcctacaaccacgccctcagcgagctgcccgagaccctggagaccctcctgctgctcacgctgctggccaccgtgaccggcggcatcttcctcttcctgatgtccgggaagggcatcgggaagatgaccctgggcatgtgctgcatcatcaccgcgagcgtgctcctgtggtacgcccagatccagccgcactggatcgccgcctccatcatcctggagttcttcctcatcgtcctgctgatccccgagcccgagaagcagcgcacgccccaggacaaccagctcacctacgtggtgatcgccatcctgaccgtcgtggcggccaccatggccaacgagatggggttcctggagaagacgaagaaggacctcggcctgggcagcatcaccacccaggagagcgagtccaacatcctggacatcgacctccggccggccagcgcctggaccctgtacgcggtggccacgaccttcgtcacccccatgctgcgccactccatcgagaacagctccgtgaacgtgagcctcaccgccatcgccaaccaggcgacggtcctgatggggctgggcaaggggtggcccctctccaagatggacatcggcgtgcccctgctggccatcgggtgctacagccaggtgaacccgatcaccctcaccgccgccctgctgctcctggtcgcccactacgcgatcatcggccccggcctgcaggccaaggccacccgggaggcccagaagcgcgccgcggccgggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcggaccacgtgggccctctgcgaggccctgaccctggccaccggccccatctccaccctctgggaggggaaccccggccgcttctggaacacgaccatcgcggtcagcatggccaacatcttccgcggctcctacctggccggggccggcctcctgttcagcatcatgaagaacaccaccaacacgcggcgcgggaccggcaacatcggcgagaccctgggggagaagtggaagtcccggctgaacgcgctcggcaagagcgagttccagatctacaagaagtccgggatccaggaggtggaccgcaccctggccaaggagggcatcaagcgcggggagacggaccaccacgccgtgagccgcggctccgccaagctgcggtggttcgtcgagcgcaacatggtgaccccggagggcaaggtggtcgacctcgggtgcggccgcgggggctggagctactactgcgggggcctgaagaacgtgcgcgaggtgaagggcctgaccaagggcggccccgggcacgaggagcccatccccatgtccacctacggctggaacctcgtccggctgcagagcggggtggacgtgttcttcacgccgcccgagaagtgcgacaccctgctctgcgacatcggcgagagctcccccaaccccaccatcgaggccggccgcaccctgcgggtcctgaacctcgtggagaactggctgaacaacaacacccagttctgcatcaaggtgctgaacccgtacatgcccagcgtcatcgagaagatggagacgctccagcgcaagtacgggggcgcgctggtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacgtacgagccggacgtggacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtcaacggggtggtgcgcctgctcaccaagccctgggacgtcgtgccgatggtgacccagatggcgatgacggacaccacccccttcggccagcagcgggtcttcaaggagaaggtggacacccgcacgcaggagcccaaggagggcaccaagaagctgatgaagatcaccgccgagtggctgtggaaggagctcgggaagaagaagacgccccggatgtgcacgcgcgaggagttcacccggaaggtgcgcagcaacgccgccctgggcgccatcttcaccgacgagaacaagtggaagtccgcgcgggaggccgtcgaggacgggcgcttctgggagctggtggaccgggagcgcaacctccacctggagggcaagtgcgagacctgcgtctacaacatgatggggaagcgggagaagaagctgggcgagttcggcaaggccaaggggagccgcgccatctggtacatgtggctcggcgcgcggttcctggagttcgaggccctggggttcctcaacgaggaccactggttctcccgcggcaacagcctgagcggggtggagggcgagggcctgcaccggctcgggtacatcctgcgcgacgtgtccaagaaggagggcggggccatgtacgccgacgacacggccggctgggacacccggatcaccctggaggacctcaagaacgaggagatggtcaccaaccacatgaagggggagcacaagaagctggcggaggccatcttcaagctgacgtaccagaacaaggtggtgcgcgtccagcggccgacgccccggggcaccgtgatggacatcatcagccggcgcgaccagcgcggctccggccaggtgggcacctacgggctcaacacgttcaccaacatggaggcccagctgatccggcagatggagggcgagggcatcttcaagagcatccagcacctgaccgccaccgaggagatcgccgtccagaactggctcgcgcgcgtggggcgggagcgcctgtcccggatggccatcagcggcgacgactgcgtggtcaagcccatcgacgaccgcttcgcctccgccctgacggccctcaacgacatggggaaggtgcggaaggacatccagcagtgggagcccagccgcggctggaacgactggacccaggtgccgttctgctcccaccacttccacgagctggtcatgaaggacgggcgggcgctggtggtgccctgccgcaaccaggacgagctcatcggccgggcccgcaccagccagggcgccgggtggtccctgaaggagaccgcctgcctgggcaagagctacgcccagatgtggaccctcatgtacttccaccggcgcgacctgcggctggcggccaacgccatctgctccgccgtccccagccactgggtgcccacgtcccgcaccacctggagcatccacgcgaagcacgagtggatgaccacggaggacatgctcgccgtgtggaaccgggtctggatccaggagaacccgtggatggaggacaagacccccgtggagtcctgggaggaggtgccctacctggggaagcgcgaggaccagtggtgcggcagcctgatcgggctcaccagccgggccacctgggccaagaacatccagacggccatcaaccaggtccgctccctgatcggcaacgaggagtacaccgactacatgcccagcatgaagcgcttccggcgcgaggaggaggaggcgggcgtgctgtggtga

SEQ ID NO: 9479 - RNA, 9876 nt, synthetic construct
  misc_feature 1..9876: note = derived and/or modified CDS sequence (opt1) from DENV-2__JN819408__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacaccaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtcgaggactacggcttcggggtgttcaccaccaacatctggctcaagctgcgcgagaagcaggacatcttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccgtgagcttcgtcaccctgatcaccgggaacatgtccttccgggacctgggccgcgtgatggtgatggtcggggccacgatgaccgacgacatcggcatgggcgtgacctacctcgccctgctggccgcgttcaaggtgcgccccaccttcgccgccgggctcctgctgcggaagctcacgagcaaggagctgatgatggccaccatcggcatcgccctgctctcccagagcaccatccccgagaccatcctggagctgacggacgcgctcgccctggggatgatggccctgaagatcgtccgcaacatggagaagtaccagctcgccgtgaccatcatggccatctcctgcgtgccgaacgcggtcatcctgcagaacgcctggaaggtgagctgcaccatcctggccgccgtgtccgtcagccccctcctgctgacctccagccagcagaaggcggactggatccccctcgccctgacgatcaagggcctgaaccccaccgccatcttcctcaccaccctgtcccggacgagcaagaagcgctcctggccgctgaacgaggccatcatggccgtgggcatggtcagcatcctcgcgtccagcctgctgaagaacgacatccccatgaccgggcccctcgtggccggcgggctgctgaccgtgtgctacgtcctcaccggccggagcgccgacctggagctggagcgcgccgccgacgtgaagtgggaggaccaggcggagatctccgggagctcccccatcctcagcatcacgatctccgaggacggcagcatgtccatcaagaacgaggaggaggagcagaccctgaccatcctgatccggaccggcctcctggtgatcagcggggtcttcccggtgtccatccccatcaccgccgccgcctggtacctgtgggaggtgaagaagcagcgcgccggcgtcctctgggacgtgcccagcccgccgcccgtggggaaggcggagctggaggacggcgcctaccggatcaagcagcgcgggatcctgggctactcccagatcggcgccggggtctacaaggagggcacgttccacaccatgtggcacgtgacccgcggggccgtgctcatgcaccgcggcaagcggatcgagcccagctgggccgacgtcaagaaggacctgatctcctacgggggcggctggaagctggagggggagtggaaggagggcgaggaggtccaggtgctcgcgctggagcccgggaagaacccccgcgccgtccagaccaagcccggcatcttccggacgaacaccgggaccatcggcgccgtgagcctggacttctcccccggcaccagcgggtcccccatcgtggaccgcaagggcaaggtcgtggggctctacggcaacggcgtggtcacgcggagcggggcctacgtgtccgcgatcgcccagaccgagaagtccatcgaggacaaccccgagatcgaggacgacatcttccgcaagaagcggctgaccatcatggacctgcaccccggcgccgggaagaccaagcgctacctccccgccatcgtgcgggaggccatcaagcgcggcctgcgcacgctgatcctggcgccgacccgggtcgtggccgccgagatggaggaggccctccgcgggctgcccatccggtaccagacccccgccatcaaggcggagcacaccggccgcgagatcgtggacctgatgtgccacgccacgttcaccatgcggctcctgagccccgtccgcgtgccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtcaccgacttcaaggggaagaccgtgtggttcgtgccgtccatcaaggccggcaacgacatcgccgcctgcctccgcaagaacggcaagaaggtcatccagctgagccggaagacgttcgactccgagtacgtgaagacccgcgccaacgactgggacttcgtggtcaccaccgacatcagcgagatgggggcgaacttcaaggccgagcgggtgatcgacccccgccggtgcatgaagcccgtgatcctgacggacggcgaggagcgcgtcatcctcgccgggcccatgccggtgacccactccagcgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgcgagaaggtggacgccatcgacggggagtaccggctgcgcggcgaggcccggaagaccttcgtcgacctgatgcgccgcggggacctccccgtgtggctggcctacaaggtggcggccgagggcatcaactacgccgaccgcaagtggtgcttcgacgggatcaagaacaaccagatcctggaggagaacgtcgaggtggagatctggacgaaggagggcgagcggaagaagctcaagccgcgctggctggacgcccggatctacagcgaccccctggcgctcaaggagttcaaggagttcgccgccggccgcaagtccctgaccctgaacctcatcaccgagatggggcggctgcccaccttcatgacgcagaaggcccgcaacgccctggacaacctcgcggtgctgcacaccgccgaggccggcgggcgggcctacaaccacgccctgagcgagctccccgagaccctggagaccctgctcctgctgacgctcctggcgaccgtcaccggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgcgatcctcaccgtggtcgccgccaccatggccaacgagatggggttcctggagaagacgaagaaggacctgggcctcggcagcatcatcacccaggagagcgagaacaacatcctggacatcgacctgcggccggcctccgcgtggaccctctacgccgtggccaccacgttcgtgacccccatgctgcgccacagcatcgagaactccagcgtcaacgtgtccctgaccgccatcgcgaaccaggccaccgtgctcatggggctgggcaaggggtggcccctgagcaagatggacatcggcgtccccctcctggccatcgggtgctactcccaggtgaacccgatcacgctgaccgccgccctcctgctgctcgtggcgcactacgccatcatcggccccggcctgcaggccaaggccacccgggaggcccagaagcgcgcggccgccgggatcatgaagaaccccaccgtcgacggcatcacggtgatcgacctggagcccatcccgtacgaccccaagttcgagaagcagctcggccaggtgatgctgctgatcctctgcgtcacccaggtgctgatgatgcggaccacctgggccctgtgcgaggccctcacgctggcgaccggccccatcagcaccctgtgggaggggaaccccggccgcttctggaacaccacgatcgccgtgtccatggccaacatcttccgcggcagctacctcgccggggcgggcctgctgttctccatcatgaagaacaccaccaacacccggcgcgggacgggcaacatcggcgagaccctcggggagaagtggaagtcccggctgaacgccctgggcaagtccgagttccagatctacaagaagtccgggatccaggaggtcgaccgcaccctcgccaaggagggcatcaagcgcggggagaccgaccaccacgccgtgtcccgcggcagcgccaagctgcggtggttcgtggagcgcaacatggtcacgccggagggcaaggtggtggacctggggtgcggccgcggcgggtggtcctactactgcggcgggctcaagaacgtccgcgaggtgaaggggctgaccaagggcggccccgggcacgaggagcccatccccatgagcacctacggctggaacctggtgcggctccagtccggggtcgacgtgttcttcaccccgcccgagaagtgcgacacgctgctgtgcgacatcggcgagagcagccccaaccccaccatcgaggcgggccgcaccctccgggtgctgaacctggtcgagaactggctcaacaacaacacccagttctgcatcaaggtgctgaacccgtacatgccctccgtgatcgagaagatggagaccctgcagcgcaagtacgggggcgccctcgtccggaaccccctgagccgcaactccacgcacgagatgtactgggtgagcaacgccaccgggaacatcgtgtccagcgtcaacatgatctcccggatgctgatcaaccgcttcaccatgaagcacaagaaggccacctacgagccggacgtggacctgggcagcgggacgcggaacatcggcatcgagggcgagatccccaacctcgacatcatcgggaagcgcatcgagaagatcaagcaggagcacgagacctcctggcactacgaccaggaccacccctacaagacctgggcctaccacggcagctacgagaccaagcagacggggtccgcgagctccatggtgaacggcgtcgtgcgcctgctgaccaagccctgggacgtggtcccgatggtgacccagatggccatgaccgacacgacccccttcggccagcagcgggtgttcaaggagaaggtcgacacccgcacccaggagcccaaggaggggacgaagaagctcatgaagatcaccgccgagtggctgtggaaggagctgggcaagaagaagacgccccggatgtgcacccgcgaggagttcacgaagaaggtgcggagcaacgccgccctcggggcgatcttcaccgacgagaacaagtggaagtccgcccgcgaggccgtggaggacggccggttctgggagctggtcgaccgcgagcggaacctgcacctcgaggggaagtgcgagacctgcgtgtacaacatgatgggcaagcgcgagaagaagctgggcgagttcgggaaggccaagggcagccgggcgatctggtacatgtggctgggggcccgcttcctcgagttcgaggccctgggcttcctgaacgaggaccactggttctcccgggggaacagcctctccggcgtggagggcgaggggctgcaccgcctgggctacatcctccgggacgtcgggaagaaggagggcggggccatgtacgccgacgacaccgcgggctgggacacgcgcatcaccctggaggacctgaagaacgaggagatggtgaccaaccacatgaagggcgagcacaagaagctcgccgaggccatcttcaagctgacctaccagaacaaggtcgtgcgggtgcagcgcccgacgccccgggggaccgtcatggacatcatcagccgccgggaccagcgcggcagcggccaggtgggcacctacggcctgaacaccttcacgaacatggaggcccagctcatccgccagatggagggggagggcatcttcaagtccatccagcacctgaccgccaccgaggagatcgcggtgcagaactggctggcccgggtcgggcgcgagcggctcagccgcatggccatctccggcgacgactgcgtggtgaagcccatcgacgaccggttcgccagcgccctgaccgcgctgaacgacatggggaaggtccgcaaggacatccagcagtgggagccctcccggggctggaacgactggacccaggtgccgttctgcagccaccacttccacgagctcgtgatgaaggacggccgcgtcctggtggtgccctgccggaaccaggacgagctgatcgggcgcgcccggatctcccagggcgccgggtggagcctcaaggagaccgcctgcctgggcaagtcctacgcccagatgtggaccctgatgtacttccaccgccgggacctccgcctggcggccaacgccatctgcagcgccgtcccctcccactgggtgcccaccagccggaccacgtggtccatccacgcgaagcacgagtggatgaccaccgaggacatgctggccgtgtggaaccgcgtctggatccaggagaacccgtggatggaggacaagacccccgtggagagctgggaggaggtgccctacctcgggaagcgggaggaccagtggtgcggctccctgatcggcctgacgagccgcgccacctgggccaagaacatccagaccgccatcaaccaggtccggtccctcatcgggaacgaggagtacaccgactacatgcccagcatgaagcgcttccgccgggaggaggaggaggcgggcgtgctgtggtga

SEQ ID NO: 9480 - RNA, 9876 nt, synthetic construct
  misc_feature 1..9876: note = derived and/or modified CDS sequence (opt1) from DENV-2__FJ639783__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcgtctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcaccgacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagacgaccatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggacgatgaagatcctgatcggcgtgatcatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcgtgggcacgaagcacgcgatcctgctcgtcgccgtgagcttcgtgaccctgatcaccgggaacatgtccttccgggacctgggccgcgtcatggtgatggtgggggccaccatgacggacgacatcggcatgggcgtcacctacctcgccctgctggccgcgttcaaggtgcgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtccgcaacatggagaagtaccagctcgccgtgacggtgatggccatctcctgcgtcccgaacgccgtgatcctgcagaacgcgtggaaggtcagctgcaccatcctggccgccgtgtccgtgagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtcggcatggtgagcatcctcgcctccagcctgctgaagaacgacatccccatgacggggcccctcgtggcgggcgggctgctgaccgtctgctacgtgctcaccggccggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtcatcagcggggtgttcccggtgtccatccccatcaccgcggccgcctggtacctgtgggaggtcaagaagcagcgcgccggcgtgctctgggacgtgcccagcccgccgcccgtcgggaaggccgagctggaggacggcgcgtaccggatcaagcagcgcgggatcctgggctactcccagatcggcgccggggtgtacaaggagggcaccttccacacgatgtggcacgtgacccgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgccctggagcccgggaagaacccccgcgcggtgcagaccaagcccggcatcttcaagaccaacacggggaccatcggcgccgtgagcctggacttctcccccggcaccagcgggtcccccatcgtcgaccggaagggcaaggtggtggggctctacggcaacggcgtcgtgacccgcagcggggcctacgtgtccgccatcgcgcagacggagaagtccatcgaggacaaccccgagatcgaggacgacatcttccggaagaagcgcctgaccatcatggacctgcaccccggcgccgggaagaccaagcggtacctccccgccatcgtccgcgaggccatcaagcggggcctgcgcaccctgatcctggccccgacgcgcgtggtggcggccgagatggaggaggccctccgggggctgcccatccgctaccagacccccgccatcaaggccgagcacaccggccgggagatcgtcgacctgatgtgccacgcgaccttcacgatgcgcctcctgagccccgtgcgggtgccgaactacaacctgatcatcatggacgaggcccacttcaccgaccccgcctccatcgccgcccgcggctacatcagcacccgggtcgagatgggggaggcggccggcatcttcatgaccgccacgccgcccgggtcccgcgacccgttcccccagagcaacgcccccatcatggacgaggagcgggagatccccgagcgctcctggaacagcggccacgagtgggtgaccgacttcaaggggaagaccgtgtggttcgtcccgtccatcaaggcgggcaacgacatcgccgcctgcctccggaagaacggcaagaaggtgatccagctgagccgcaagaccttcgactccgagtacgtgaagacgcgggccaacgactgggacttcgtcgtgaccaccgacatcagcgagatgggggccaacttcaaggcggagcgcgtgatcgacccccggcgctgcatgaagcccgtcatcctgaccgacggcgaggagcgggtgatcctcgccgggcccatgccggtgacgcactccagcgccgcccagcgccggggccgcatcgggcgcaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgggagaaggtcgacgccatcgacggggagtaccgcctgcggggcgaggcccgcaagaccttcgtggacctgatgcggcgcggggacctccccgtgtggctggcctacaaggtcgccgcggagggcatcaactacgccgaccggaagtggtgcttcgacgggatcaagaacaaccagatcctggaggagaacgtggaggtcgagatctggaccaaggagggcgagcgcaagaagctcaagccgcggtggctggacgcccgcatctacagcgaccccctggccctcaaggagttcaaggagttcgcggccggccggaagtccctgacgctgaacctcatcaccgagatggggcgcctgcccaccttcatgacccagaaggcccggaacgccctggacaacctcgccgtgctgcacacggcggaggccggcgggcgcgcctacaaccacgccctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgcgagcgtcctgctctggtacgcccagatccagccgcactggatcgccgcctccatcatcctggagttcttcctgatcgtgctcctgatccccgagcccgagaagcagcggacgccccaggacaaccagctgacgtacgtggtcatcgccatcctcaccgtggtggcggccaccatggccaacgagatggggttcctggagaagaccaagaaggacctgggcctcggcagcatcacgacccaggagagcgagtccaacatcctggacatcgacctgcgcccggccagcgcctggaccctctacgcggtcgccaccacgttcgtgacccccatgctgcggcactccatcgagaacagctccgtgaacgtcagcctgaccgccatcgccaaccaggcgaccgtgctcatggggctgggcaaggggtggcccctgtccaagatggacatcggcgtgcccctcctggccatcgggtgctacagccaggtcaacccgatcacgctgaccgccgccctcctgctgctcgtggcccactacgcgatcatcggccccggcctgcaggccaaggccacccgcgaggcccagaagcgggccgcggccgggatcatgaagaaccccaccgtggacggcatcacggtcatcgacctggagcccatcccgtacgaccccaagttcgagaagcagctcggccaggtgatgctgctgatcctctgcgtgacccaggtcctgatgatgcgcaccacctgggccctgtgcgaggccctcacgctggccaccggccccatctccaccctgtgggaggggaaccccggccggttctggaacaccacgatcgcggtgagcatggccaacatcttccgcggctcctacctcgccggggccggcctgctgttcagcatcatgaagaacaccaccaacacccgccgggggacgggcaacatcggcgagaccctcggggagaagtggaagtcccgcctgaacgcgctgggcaagagcgagttccagatctacaagaagtccgggatccaggaggtggaccggaccctcgccaaggagggcatcaagcgcggggagaccgaccaccacgccgtcagccggggctccgccaagctgcgctggttcgtggagcggaacatggtgacgccggagggcaaggtcgtggacctggggtgcggccgcgggggctggagctactactgcgggggcctcaagaacgtgcgggaggtcaagggcctgaccaagggcgggcccgggcacgaggagcccatccccatgtccacctacggctggaacctggtgcgcctccagagcggggtggacgtcttcttcaccccgcccgagaagtgcgacacgctgctgtgcgacatcggcgagagctcccccaaccccaccatcgaggccggccggaccctccgcgtgctgaacctggtggagaactggctcaacaacaacacccagttctgcatcaaggtcctgaacccgtacatgcccagcgtgatcgagaagatggagaccctgcagcggaagtacgggggcgcgctcgtgcgcaaccccctgtcccggaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctgggctccgggacgcgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagaccaagcagacgggctccgccagctccatggtgaacggggtggtccgcctgctgaccaagccctgggacgtggtgccgatggtcacccagatggcgatgaccgacacgacccccttcggccagcagcgcgtgttcaaggagaaggtggacacccggacccaggagcccaaggagggcacgaagaagctcatgaagatcaccgccgagtggctgtggaaggagctggggaagaagaagacgccccgcatgtgcacccgggaggagttcacgcgcaaggtccggagcaacgccgccctcggcgccatcttcaccgacgagaacaagtggaagtccgcgcgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtggagggcgagggcctgcaccgcctggggtacatcctccgggacgtcggcaagaaggagggcggcgccatgtacgccgacgacaccgccgggtgggacacgcgcatcaccctggaggacctgaagaacgaggagatggtgaccaaccacatgaagggcgagcacaagaagctcgcggaggccatcttcaagctgacctaccagaacaaggtggtccgggtgcagcgcccgacgccccggggcaccgtgatggacatcatctcccgccgggaccagcgcgggagcggccaggtcgggacctacggcctgaacaccttcacgaacatggaggcccagctcatccgccagatggagggcgaggggatcttcaagtccatccagcacctgaccgccaccgaggagatcgccgtgcagaactggctggcgcgggtgggccgcgagcggctcagccgcatggccatctccggggacgactgcgtcgtgaagcccatcgacgaccggttcgccagcgccctgaccgccctgaacgacatgggcaaggtgcgcaaggacatccagcagtgggagccctcccgggggtggaacgactggacgcaggtcccgttctgcagccaccacttccacgagctcgtgatgaaggacggccgcgtgctggtcgtgccctgccggaaccaggacgagctgatcggccgcgcgcggatctcccagggggccggctggagcctcaaggagaccgcctgcctggggaagtcctacgcccagatgtggaccctgatgtacttccaccgccgggacctccgcctggccgcgaacgccatctgcagcgccgtgccctcccactgggtccccaccagccggaccacgtggtccatccacgccaagcacgagtggatgaccaccgaggacatgctggcggtgtggaaccgcgtgtggatccaggagaacccgtggatggaggacaagacccccgtcgagagctgggaggaggtgccctacctcggcaagcgggaggaccagtggtgcgggtccctgatcggcctgacgagccgcgccacctgggccaagaacatccagaccgccatcaaccaggtgcggagcctcatcggcaacgaggagtacaccgactacatgccctccatgaagcgcttccgccgggaggaggaggaggccggggtcctgtggtga

SEQ ID NO: 9481 - RNA, 9876 nt, synthetic construct
  misc_feature 1..9876: note = derived and/or modified CDS sequence (opt1) from DENV-2__FJ639788__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccgccggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggcggccatcctggcctacaccatcgggaccacccacttccagcgggccctcatcttcatcctgctgaccgcggtggcccccagcatgaccatgcgctgcatcggcgtctccaaccgggacttcgtggagggcgtgagcgggggctcctgggtcgacatcgtgctcgagcacgggagctgcgtgaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtcgaccggggctgggggaacggctgcgggctgttcggcaagggcgggatcgtgacgtgcgccatgttcacgtgcaagaagaacatggagggcaaggtggtccagcccgagaacctggagtacaccatcgtgatcacgccccacagcggggaggagcacgccgtgggcaacgacacggggaagcacggcaaggagatcaagatcaccccgcagtccagcatcaccgaggccgagctgaccgggtacggcaccgtcacgatggagtgcagcccccggaccggcctcgacttcaacgagatggtgctgctgcagatggaggacaaggcctggctcgtgcaccggcagtggttcctggacctgcccctcccctggctgccgggggcggacacccagggcagcaactggatccagaaggagaccctggtcacgttcaagaacccccacgccaagaagcaggacgtggtcgtgctcgggtcccaggagggcgccatgcacaccgccctgaccggggccaccgagatccagatgagcagcggcaacctcctgttcacgggccacctgaagtgccgcctgcggatggacaagctccagctgaaggggatgtcctacagcatgtgcaccggcaagttcaagatcgtgaaggagatcgcggagacccagcacgggaccatcgtcatccgcgtgcagtacgagggcgacggctccccctgcaagatccccttcgagatcacggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtgttcggggccatctacggcgccgccttcagcggggtctcctggaccatgaagatcctgatcggcgtgatcatcacgtggatcgggatgaacagccgctccaccagcctgtccgtgagcctggtcctcgtgggcgtggtcaccctgtacctgggggcgatggtgcaggccgactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggcgggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtgttcacgaccaacatctggctcaagctgcgcgagaagcaggacgtcttctgcgactccaagctgatgagcgccgcgatcaaggacaaccgggccgtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgcggggcccgtgtcccagcacaactaccgcccgggctaccacacccagacggccgggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggcgctgttcctcgaggagatgctgcggacccgcgtgggcaccaagcacgccatcctgctcgtcgccgtgagcttcgtgacgctgatcaccgggaacatgtccttccgggacctgggccgcgtcatggtgatggtgggggccaccatgaccgacgacatcggcatgggcgtcacgtacctcgccctgctggcggccttcaaggtgcgccccaccttcgccgccgggctcctgctgcggaagctcaccagcaaggagctgatgatggccaccatcggcatcgcgctgctctcccagagcacgatccccgagaccatcctggagctgaccgacgccctcgccctggggatgatggtgctgaagatcgtccgcaacatggagaagtaccagctcgccgtgaccgtgatggccatctcctgcgtcccgaacgcggtgatcctgcagaacgcctggaaggtcagctgcacgatcctggccgccgtgtccgtgagccccctcctgctgacctccagccagcagaaggcggactggatccccctcgccctgaccatcaagggcctgaaccccaccgccatcttcctcacgaccctgtcccggaccagcaagaagcgctcctggccgctgaacgaggccatcatggccgtcggcatggtgagcatcctcgcgtccagcctgctgaagaacgacatccccatgaccgggcccctcgtggccggcgggctgctgacggtctgctacgtgctcaccggccggagcgccgacctggagctggagcgcgccgccgacgtgaagtgggaggaccaggcggagatctccgggagctcccccatcctcagcatcaccatctccgaggacggcagcatgtccatcaagaacgaggaggaggagcagaccctgacgatcctgatccggaccggcctcctggtcatcagcggggtgttcccggtgtccatccccatcaccgccgccgcctggtacctgtgggaggtcaagaagcagcgcgccggcgtgctctgggacgtgcccagcccgccgcccgtcgggaaggcggagctggaggacggcgcctaccggatcaagcagcgcgggatcctgggctactcccagatcggcgccggggtgtacaaggagggcaccttccacaccatgtggcacgtgacgcgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgcgctggagcccgggaagaacccccgcgccgtgcagaccaagcccggcatcttcaagaccaacaccgggacgatcggcgccgtgagcctggacttctcccccggcaccagcgggtcccccatcgtcgaccggaagggcaaggtggtggggctctacggcaacggcgtcgtgacccgcagcggggcctacgtgtccgcgatcgcccagaccgagaagtccatcgaggacaaccccgagatcgaggacgacatcttccggaagaagcgcctgacgatcatggacctgcaccccggcgccgggaagaccaagcggtacctccccgccatcgtccgcgaggccatcaagcggggcctgcgcaccctgatcctggcgccgacccgcgtggtggccgccgagatggaggaggccctccgggggctgcccatccgctaccagacgcccgccatcaaggcggagcacaccggccgggagatcgtcgacctgatgtgccacgccaccttcaccatgcgcctcctgagccccgtgcgggtgccgaactacaacctgatcatcatggacgaggcccacttcacggaccccgcctccatcgccgcgcgcggctacatcagcacccgggtcgagatgggggaggccgccggcatcttcatgaccgccacgccgcccgggtcccgcgacccgttcccccagagcaacgcgcccatcatggacgaggagcgggagatccccgagcgctcctggaacagcggccacgagtgggtgacggacttcaaggggaagaccgtgtggttcgtcccgtccatcaaggccggcaacgacatcgccgcctgcctccggaagaacggcaagaaggtgatccagctgagccgcaagaccttcgactccgagtacgtgaagacccgggccaacgactgggacttcgtcgtgacgaccgacatcagcgagatgggggcgaacttcaaggccgagcgcgtgatcgacccccggcgctgcatgaagcccgtcatcctgaccgacggcgaggagcgggtgatcctcgccgggcccatgccggtgacccactccagcgccgcccagcgccggggccgcatcgggcgcaaccccaagaacgagaacgaccagtacatctacatgggcgagcccctggagaacgacgaggactgcgcgcactggaaggaggccaagatgctgctcgacaacatcaacacgcccgagggcatcatcccgtccatgttcgagcccgagcgggagaaggtcgacgccatcgacggggagtaccgcctgcggggcgaggcccgcaagaccttcgtggacctgatgcggcgcggggacctccccgtgtggctggcctacaaggtcgcggccgagggcatcaactacgccgaccggaagtggtgcttcgacgggatcaagaacaaccagatcctggaggagaacgtggaggtcgagatctggaccaaggagggcgagcgcaagaagctcaagccgcggtggctggacgcccgcatctacagcgaccccctggcgctcaaggagttcaaggagttcgccgccggccggaagtccctgaccctgaacctcatcacggagatggggcgcctgcccaccttcatgacccagaaggcccggaacgccctggacaacctcgcggtgctgcacaccgccgaggccggcgggcgcgcctacaaccacgccctgagcgagctccccgagacgctggagaccctgctcctgctgaccctcctggcgaccgtgacgggcggcatcttcctgttcctcatgtccgggaagggcatcgggaagatgaccctgggcatgtgctgcatcatcaccgccagcgtcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcacggtggtggccgccaccatggccaacgagatggggttcctggagaagaccaagaaggacctgggcctcggcagcatcaccacgcaggagagcgagtccaacatcctggacatcgacctgcgcccggccagcgcgtggaccctctacgccgtcgccaccaccttcgtgacgcccatgctgcggcactccatcgagaacagctccgtgaacgtcagcctgaccgccatcgcgaaccaggccaccgtgctcatggggctgggcaaggggtggcccctgtccaagatggacatcggcgtgcccctcctggccatcgggtgctacagccaggtcaacccgatcaccctgacggccgccctcctgctgctcgtggcgcactacgccatcatcggccccggcctgcaggccaaggccacccgcgaggcccagaagcgggcggccgccgggatcatgaagaaccccaccgtggacggcatcaccgtcatcgacctggagcccatcccgtacgaccccaagttcgagaagcagctcggccaggtgatgctgctgatcctctgcgtgacgcaggtcctgatgatgcgcaccacctgggccctgtgcgaggccctcaccctggcgacgggccccatctccaccctgtgggaggggaaccccggccggttctggaacaccaccatcgccgtgagcatggccaacatcttccgcggctcctacctcgccggggcgggcctgctgttcagcatcatgaagaacacgaccaacacccgccgggggaccggcaacatcggcgagacgctcggggagaagtggaagtcccgcctgaacgccctgggcaagagcgagttccagatctacaagaagtccgggatccaggaggtggaccggaccctcgccaaggagggcatcaagcgcggggagaccgaccaccacgccgtcagccggggctccgccaagctgcgctggttcgtggagcggaacatggtgaccccggagggcaaggtcgtggacctggggtgcggccgcgggggctggagctactactgcgggggcctcaagaacgtgcgggaggtcaagggcctgacgaagggcgggcccgggcacgaggagcccatccccatgtccacctacggctggaacctggtgcgcctccagagcggggtggacgtcttcttcaccccgcccgagaagtgcgacaccctgctgtgcgacatcggcgagagctcccccaaccccacgatcgaggcgggccggaccctccgcgtgctgaacctggtggagaactggctcaactacaacacccagttctgcatcaaggtcctgaacccgtacatgcccagcgtgatcgagaagatggagaccctgcagcggaagtacgggggcgccctcgtgcgcaaccccctgtcccggaacagcacccacgagatgtactgggtctccaacgccacggggaacatcgtgagctccgtgaacatgatcagccgcatgctgatcaaccggttcaccatgaagcacaagaaggccacctacgagccggacgtcgacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgcgagctccatggtgaacggggtggtccgcctgctgacgaagccctgggacgtggtgccgatggtcacccagatggccatgaccgacaccacgcccttcggccagcagcgcgtgttcaaggagaaggtggacacccggacccaggagcccaaggagggcaccaagaagctcatgaagatcacggccgagtggctgtggaaggagctggggaagaagaagacgccccgcatgtgcacccgggaggagttcacccgcaaggtccggagcaacgccgccctcggcgcgatcttcacggacgagaacaagtggaagtccgcccgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggagccgggcgatctggtacatgtggctgggcgcccgcttcctcgagttcgaggccctggggttcctgaacgaggaccactggttctcccggggcaacagcctcagcggggtggagggcgagggcctgcaccgcctggggtacatcctccgggacgtcggcaagaaggagggcggcgccatgtacgccgacgacaccgcggggtgggacacccgcatcacgctggaggacctgaagaacgaggagatggtgaccaaccacatgaagggcgagcacaagaagctcgccgaggccatcttcaagctgacctaccagaacaaggtggtccgggtgcagcgcccgacgccccggggcacggtgatggacatcatctcccgccgggaccagcgcgggagcggccaggtcgggacctacggcctgaacaccttcaccaacatggaggcccagctcatccgccagatggagggcgaggggatcttcaagtccatccagcacctgacggccaccgaggagatcgcggtgcagaactggctggcccgggtgggccgcgagcggctcagccgcatggccatctccggggacgactgcgtcgtgaagcccatcgacgaccggttcgccagcgccctgaccgcgctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcggccgcgcccggatctcccagggggccggctggagcctcaaggagacggcctgcctggggaagtcctacgcccagatgtggaccctgatgtacttccaccgccgggacctccgcctggcggccaacgccatctgcagcgccgtgccctcccactgggtccccaccagccggaccacctggtccatccacgcgaagcacgagtggatgacgaccgaggacatgctggccgtgtggaaccgcgtgtggatccaggagaacccgtggatggaggacaagacccccgtcgagagctgggaggaggtgccctacctcggcaagcgggaggaccagtggtgcgggtccctgatcggcctgaccagccgcgccacgtgggccaagaacatccagaccgccatcaaccaggtgcggagcctcatcggcaacgaggagtacaccgactacatgccctccatgaagcgcttccgccgggaggaggaggaggcgggggtcctgtggtga

SEQ ID NO: 9482 - RNA, 9876 nt, synthetic construct
  misc_feature 1..9876: note = derived and/or modified CDS sequence (opt1) from DENV-2__FJ639822__SS-prME
  source 1..9876: mol_type = other RNA
accgcgggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcgtctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcggcctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcatcgaggccgagctgaccgggtacggcaccgtcacgatggagtgcagcccccggaccggcctcgacttcaacgagatggtgctgctgcagatggaggacaaggcctggctcgtgcaccggcagtggttcctggacctgcccctcccctggctgccgggggccgacacccagggcagcaactggatccagaaggagaccctggtcacgttcaagaacccccacgcgaagaagcaggacgtggtcgtgctcgggtcccaggagggcgccatgcacaccgccctgaccggggccaccgagatccagatgagcagcggcaacctcctcttcacgggccacctgaagtgccgcctgcggatggacaagctccagctgaaggggatgtcctacagcatgtgcaccggcaagttcaagatcgtgaaggagatcgccgagacccagcacgggaccatcgtcatccgcgtgcagtacgagggcgacggctccccctgcaagatccccttcgagatcacggacctggagaagcggcacgtgctcgggcgcctgatcaccgtcaacccgatcgtgaccggcaaggacagccccgtgaacatcgaggcggagccgcccttcggggactcctacatcatcatcggcgtcgagccggggcagctgaagctcaactggttcaagaagggcagctccatcggccagatgttcgagaccacgatgcgcggggccaagcggatggccatcctgggcgacaccgcctgggacttcgggagcctgggcggggtgttcacctccatcggcaaggccctccaccaggtgttcggcgcgatctacggggccgccttcagcggcgtctcctggaccatgaagatcctgatcggggtgatcatcacgtggatcggcatgaacagccgctccaccagcctgtccgtgagcctggtcctcgtgggggtggtcaccctgtacctgggcgccatggtgcaggcggactccggctgcgtggtcagctggaagaacaaggagctcaagtgcgggtccggcatcttcatcaccgacaacgtgcacacgtggaccgagcagtacaagttccagcccgagagccccagcaagctggcctccgccatccagaaggcccacgaggaggggatctgcggcatccggagcgtgacccgcctggagaacctcatgtggaagcagatcacccccgagctgaaccacatcctgtccgagaacgaggtcaagctcacgatcatgaccggggacatcaagggcatcatgcaggccggcaagcggagcctgcgcccgcagcccaccgagctgaagtactcctggaagacctgggggaaggcgaagatgctcagcacggagtcccacaaccagaccttcctgatcgacggccccgagaccgccgagtgcccgaacaccaaccgggcctggaacagcctggaggtggaggactacgggttcggcgtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggggtcctggagagcgagatgatcatccccaagaacttcgccggccccgtgtcccagcacaactaccgcccggggtaccacacccagacggcgggcccctggcacctcgggaagctggagatggacttcgacttctgcgagggcaccaccgtggtcgtgaccgaggactgcggcaaccgggggcccagcctgcgcacgaccaccgccagcggcaagctcatcaccgagtggtgctgccggtcctgcacgctgcccccgctgcgctaccgcggggaggacggctgctggtacgggatggagatccgccccctcaaggagaaggaggagaacctggtgaacagcctggtcaccgccggccacggccagatcgacaacttctccctcggggtgctgggcatggccctgttcctcgaggagatgctgcggacccgcgtggggaccaagcacgcgatcctgctcgtcgccgtgagcttcgtgacgctgatcaccggcaacatgtccttccgggacctggggcgcgtcatggtgatggtgggcgccaccatgaccgacgacatcggcatgggggtcacgtacctcgccctgctggccgcgttcaaggtgcgccccaccttcgccgccggcctcctgctgcggaagctcaccagcaaggagctgatgatggccaccatcgggatcgccctgctctcccagagcacgatccccgagaccatcctggagctgaccgacgcgctcgccctgggcatgatggtgctgaagatcgtccgcaacatggagaagtaccagctcgccgtgaccgtgatggccatctcctgcgtcccgaacgccgtgatcctgcagaacgcgtggaaggtcagctgcacgatcctggccgccgtgtccgtgagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtcgggatggtgagcatcctcgcctccagcctgctgaagaacgacatccccatgaccggccccctcgtggccggcgggctgctgacggtctgctacgtgctcaccgggcggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagaccctgacgatcctgatccggaccgggctcctggtcatcagcggcgtgttcccggtgtccatccccatcaccgcggccgcctggtacctgtgggaggtcaagaagcagcgcgccggggtgctctgggacgtgcccagcccgccgcccgtcggcaaggccgagctggaggacggggcgtaccggatcaagcagcgcggcatcctgggctactcccagatcggggccggcgtgtacaaggaggggaccttccacaccatgtggcacgtgacgcggggcgccgtcctcatgcaccgcgggaagcggatcgagcccagctgggccgacgtgaagaaggacctgatctcctacggcggcgggtggaagctggagggcgagtggaaggagggggaggaggtgcaggtcctcgccctggagcccggcaagaacccccgcgcggtgcagaccaagcccgggatcttcaagaccaacaccggcacgatcggcgccgtgagcctggacttctcccccgggaccagcggctcccccatcgtcgaccggaaggggaaggtggtgggcctctacggcaacggggtcgtgacccgcagcggcgcctacgtgtccgccatcgcgcagaccgagaagtccatcgaggacaaccccgagatcgaggacgacatcttccggaagaagcgcctgacgatcatggacctgcaccccggggccggcaagaccaagcggtacctccccgccatcgtccgcgaggccatcaagcgggggctgcgcaccctgatcctggccccgacccgcgtggtggcggccgagatggaggaggccctccggggcctgcccatccgctaccagacgcccgccatcaaggccgagcacaccggccgggagatcgtcgacctgatgtgccacgcgaccttcaccatgcgcctcctgagccccgtgcgggtgccgaactacaacctgatcatcatggacgaggcccacttcacggaccccgcctccatcgccgcccgcgggtacatcagcacccgggtcgagatgggcgaggcggccgggatcttcatgaccgccacgccgcccggctcccgcgacccgttcccccagagcaacgcccccatcatggacgaggagcgggagatccccgagcgctcctggaacagcgggcacgagtgggtgacggacttcaagggcaagaccgtgtggttcgtcccgtccatcaaggcgggcaacgacatcgccgcctgcctccggaagaacgggaagaaggtgatccagctgagccgcaagaccttcgactccgagtacgtgaagacccgggccaacgactgggacttcgtcgtgacgaccgacatcagcgagatgggcgccaacttcaaggcggagcgcgtgatcgacccccggcgctgcatgaagcccgtcatcctgaccgacggggaggagcgggtgatcctcgccggccccatgccggtgacccactccagcgccgcccagcgccgggggcgcatcggccgcaaccccaagaacgagaacgaccagtacatctacatgggcgagcccctggagaacgacgaggactgcgcccactggaaggaggcgaagatgctgctcgacaacatcaacacgcccgaggggatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcctacaaggtcgccgcggaggggatcaactacgccgaccggaagtggtgcttcgacggcatcaagaacaaccagatcctggaggagaacgtggaggtcgagatctggaccaaggagggcgagcgcaagaagctcaagccgcggtggctggacgcccgcatctacagcgaccccctggccctcaaggagttcaaggagttcgcggccgggcggaagtccctggccctgaacctcatcaccgagatgggccgcctgcccacgttcatgacccagaaggcccggaacgccctggacaacctcgcggtgctgcacaccgccgaggccgggggccgcgcctacaaccacgccctgagcgagctccccgagaccctggagacgctgctcctgctgaccctcctggcgaccgtgaccggcgggatcttcctgttcctcatgtccggcaaggggatcggcaagatgacgctggggatgtgctgcatcatcaccgccagcgtcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcaccgtggtggccgccacgatggccaacgagatgggcttcctggagaagaccaagaaggacctgggcctcgggagcatcaccacccaggagagcgagtccaacatcctggacatcgacctgcgcccggccagcgcgtggacgctctacgccgtcgccaccaccttcgtgacccccatgctgcggcactccatcgagaacagctccgtgaacgtcagcctgacggccatcgcgaaccaggccaccgtgctcatgggcctggggaagggctggcccctgtccaagatggacatcggggtgcccctcctggccatcggctgctacagccaggtcaacccgatcaccctgaccgccgccctcctgctgctcgtggcgcactacgccatcatcggccccgggctgcaggccaaggccacgcgcgaggcccagaagcgggcggccgccggcatcatgaagaaccccaccgtggacgggatcaccgtcatcgacctggagcccatcccgtacgaccccaagttcgagaagcagctcggccaggtgatgctgctgatcctctgcgtgacccaggtcctgatgatgcgcacgacctgggccctgtgcgaggccctcaccctggcgaccgggcccatctccacgctgtgggagggcaaccccggccggttctggaacaccaccatcgccgtgagcatggccaacatcttccgcgggtcctacctcgccggcgcggggctgctgttcagcatcatgaagaacaccacgaacacccgccggggcaccggcaacatcggggagaccctcggcgagaagtggaagtcccgcctgaacgccctgggcaagagcgagttccagatctacaagaagtccggcatccaggaggtggaccggacgctcgccaaggaggggatcaagcgcggcgagaccgaccaccacgccgtcagccggggctccgccaagctgcgctggttcgtggagcggaacatggtgaccccggaggggaaggtcgtggacctgggctgcgggcgcggcgggtggagctactactgcggcggcctcaagaacgtgcgggaggtcaaggggctgaccaagggcgggcccggccacgaggagcccatccccatgtccacgtacgggtggaacctggtgcgcctccagagcggcgtggacgtcttcttcaccccgcccgagaagtgcgacaccctgctgtgcgacatcggcgagagctcccccaaccccaccatcgaggcggggcggacgctccgcgtgctgaacctggtggagaactggctcaacaacaacacccagttctgcatcaaggtcctgaacccgtacatgcccagcgtgatcgagaagatggagaccctgcagcggaagtacggcggggccctcgtgcgcaaccccctgtcccggaacagcacccacgagatgtactgggtctccaacgccaccggcaacatcgtgagctccgtgaacatgatcagccgcatgctgatcaaccggttcacgatgaagcacaagaaggccacctacgagccggacgtcgacctggggtccggcacccgcaacatcggcatcgagagcgagatccccaacctcgacatcatcgggaagcggatcgagaagatcaagcaggagcacgagacctcctggcactacgaccaggaccacccctacaagacgtgggcctaccacggcagctacgagaccaagcagaccgggtccgcgagctccatggtgaacggcgtggtccgcctgctgaccaagccctgggacgtggtgccgatggtcacgcagatggccatgaccgacaccacccccttcggccagcagcgcgtgttcaaggagaaggtggacacgcggacccaggagcccaaggaggggaccaagaagctcatgaagatcaccgccgagtggctgtggaaggagctgggcaagaagaagacgccccgcatgtgcacccgggaggagttcacccgcaaggtccggagcaacgccgccctcggggcgatcttcaccgacgagaacaagtggaagtccgcccgcgaggccgtggaggacggccggttctgggagctggtcgaccgcgagcggaacctgcacctcgaggggaagtgcgagacgtgcgtgtacaacatgatgggcaagcgcgagaagaagctgggcgagttcgggaaggccaagggcagccgggcgatctggtacatgtggctgggggcccgcttcctcgagttcgaggccctgggcttcctgaacgaggaccactggttctcccgggggaacagcctcagcggcgtggagggcgaggggctgcaccgcctgggctacatcctccgggacgtcgggaagaaggagggcggggccatgtacgccgacgacaccgcgggctgggacacccgcatcaccctggaggacctgaagaacgaggagatggtgacgaaccacatgaagggcgagcacaagaagctcgccgaggccatcttcaagctgacctaccagaacaaggtggtccgggtgcagcgcccgacgccccgggggaccgtgatggacatcatctcccgcaaggaccagcggggcagcgggcaggtcggcacgtacggcctgaacaccttcaccaacatggaggcccagctcatccgccagatggagggggagggcatcttcaagtccatccagcacctgaccgccacggaggagatcgcggtgcagaactggctgacccgcgtggggcgggagcgcctcagccggatggccatctccggcgacgactgcgtcgtgaagcccatcgacgaccgcttcgccagcgccctgaccgccctgaacgacatggggaaggtgcggaaggacatccagcagtgggagccctcccgcggctggaacgactggacccaggtcccgttctgcagccaccacttccacgagctcgtgatgaaggacggccgggtgctggtcgtgccctgccgcaaccaggacgagctgatcgggcgggcgcgcatctcccagggcgccgggtggagcctcaaggagacggcctgcctgggcaagtcctacgcccagatgtggaccctgatgtacttccaccggcgcgacctccggctggccgcgaacgccatctgcagcgccgtgccctcccactgggtccccaccagccgcaccacctggtccatccacgccaagcacgagtggatgacgaccgaggacatgctggcggtgtggaaccgggtgtggatccaggagaacccgtggatggaggacaagacccccgtcgagagctgggaggaggtgccctacctcgggaagcgcgaggaccagtggtgcggctccctgatcggcctgaccagccgggccacgtgggccaagaacatccagaccgccatcaaccaggtgcgcagcctcatcgggaacgaggagtacaccgactacatgccctccatgaagcggttccgccgcgaggaggaggaggccggcgtcctgtggtga

SEQ ID NO: 9483 - RNA, 9876 nt, synthetic construct
  misc_feature 1..9876: note = derived and/or modified CDS sequence (opt1) from DENV-2__FJ850112__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgatcgagaaggacagccccgtcaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggccttcacctccatcgggaaggcgctccaccaggtgttcggggccatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggcgatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggcgggcaagcggagcctgcgcccgcagcccaccgagctgaagtactcctggaagacgtggggcaaggccaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgcgatcaaggacaaccgggccgtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgcggggcccgtgtcccagcacaactaccgcccgggctaccacacgcagaccgccgggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggcgctgttcctcgaggagatgctgcggacccgcgtcggcacgaagcacgccatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggcggccttcaaggtgcgccccaccttcgccgccgggctcctgctgcggaagctcaccagcaaggagctgatgatggccacgatcggcatcaccctgctctcccagagcaccatccccgagaccatcctggagctgacggacgcgctcgccctggggatgatggtcctgaagatcgtgcgcaagatggagaagtaccagctcgccgtgaccatcatggccatctcctgcgtcccgaacgccgtgatcctgcggaacgcgtggaaggtgagctgcaccatcctggccgccgtctccgtgagccccctcctgctgacctccagccagcagaaggccgactggatccccctcgcgctgacgatcaagggcctgaaccccaccgccatcttcctcaccaccctgtcccgcacgagcaagaagcggtcctggccgctgaacgaggccatcatggccgtcggcatggtgagcatcctcgcctccagcctgctgaagaacgacatccccatgaccgggcccctcgtggcgggcgggctgctgaccgtctgctacgtgctcaccggccgcagcgccgacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgcggccgcctggtacctgtgggaggtcaagaagcagcgggccggcgtgctctgggacgtgcccagcccgccgcccgtcgggaaggccgagctggaggacggcgcgtaccgcatcaagcagcgggggatcctgggctactcccagatcggcgccggggtgtacaaggagggcacgttccacaccatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggcggtgcagaccaagcccggcatcttcaagacgaacaccgggaccatcggcgccgtgagcctggacttctcccccggcaccagcgggtcccccatcgtcgaccgcaagggcaaggtggtggggctctacggcaacggcgtcgtgacgcggagcggggcctacgtgtccgccatcgcgcagaccgagaagtccatcgaggacaaccccgagatcgaggacgacatcttccgcaagaagcggctgaccatcatggacctgcaccccggcgccgggaagaccaagcgctacctccccgccatcgtccgggaggccatcaagcgcggcctgcgcacgctgatcctggccccgacccgggtggtggcggccgagatggaggaggccctccgcgggctgcccatccggtaccagacccccgccatcaaggccgagcacaccggccgcgagatcgtcgacctgatgtgccacgcgacgttcaccatgcggctcctgagccccgtgcgcgtgccgaactacaacctgatcatcatggacgaggcccacttcaccgaccccgcctccatcgccgcccggggctacatcagcacccgcgtcgagatgggggaggcggccggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggcgggcaacgacatcgccgcctgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggcggagcgggtgatcgacccccgccggtgcatgaagcccgtcatcctgacggacggcgaggagcgcgtgatcctcgccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgcgagaaggtcgacgccatcgacggggagtaccggctgcgcggcgaggcccggaagaccttcgtggacctgatgcgccgcggggacctccccgtgtggctggcctacaaggtcgccgcggagggcatcaactacgccgaccgcaagtggtgcttcgacgggatcaagaacaaccagatcctggaggagaacgtggaggtggagatctggacgaaggagggcgagcggaagaagctcaagccgcgctggctggacgcccggatctacagcgaccccctggccctcaaggagttcaaggagttcgcggccggccgcaagtccctgaccctgaacctcatcaccgagatggggcggctgcccaccttcatgacgcagaaggcccgcaacgccctggacaacctcgccgtcctgcacaccgcggaggccggcgggcgggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgcgagcgtcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggcggccaccatggccaacgagatggggttcctggagaagacgaagaaggacctgggcctcggcagcatcaccacccaggagagcgagtccaacatcctggacatcgacctgcggccggccagcgcctggaccctctacgcggtcgccacgaccttcgtgacccccatgctgcgccactccatcgagaacagctccgtgaacgtcagcctgaccgccatcgccaaccaggcgacggtgctcatggggctgggcaaggggtggcccctgtccaagatggacatcggcgtgcccctcctggccatcgggtgctacagccaggtcaacccgatcaccctgaccgccgccctcctgctgctcgtggcccactacgcgatcatcggccccggcctgcaggccaaggccacccgggaggcccagaagcgcgccgcggccgggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcggaccacgtgggccctgtgcgaggccctcaccctggccaccggccccatctccaccctgtgggaggggaaccccggccgcttctggaacacgaccatcgcggtgagcatggccaacatcttccgcggctcctacctcgccggggccggcctgctgttcagcatcatgaagaacaccaccaacacgcggcgcgggaccggcaacatcggcgagaccctcggggagaagtggaagtcccggctgaacgcgctgggcaagagcgagttccagatctacaagaagtccgggatccaggaggtggaccgcaccctcgccaaggagggcatcaagcgcggggagacggaccaccacgccgtcagccgcggctccgccaagctgcggtggttcgtggagcgcaacatggtgaccccggagggcaaggtcgtggacctggggtgcggccgcggcgggtggagctactactgcggcgggctcaagaacgtgcgcgaggtcaaggggctgaccaagggcggccccgggcacgaggagcccatccccatgtccacctacggctggaacctggtgcggctccagagcggggtggacgtcttcttcacgccgcccgagaagtgcgacaccctgctgtgcgacatcggcgagagctcccccaaccccaccatcgaggccggccgcaccctccgggtgctgaacctggtggagaactggctcaacaacaacacccagttctgcatcaaggtcctgaacccgtacatgcccagcgtgatcgagaagatggagacgctgcagcgcaagtacgggggcgcgctcgtgcggaaccccctgtcccgcaacagcacccacgagatgtactgggtctccaacgccaccgggaacatcgtgagctccgtgaacatgatcagccggatgctgatcaaccgcttcaccatgaagcacaagaaggccacgtacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggcgatgacggacaccacccccttcggccagcagcgggtgttcaaggagaaggtggacacccgcacgcaggagcccaaggagggcaccaagaagctcatgcggatcaccgccgagtggctgtggaaggagctggggaagaagaagacgccccggatgtgcacgcgggaggagttcacccgcaaggtccggagcaacgccgccctcggcgccatcttcaccgacgagaacaagtggaagtccgcgcgcgaggccgtggaggacgggcggttctgggagctggtggacaaggagcgcaacctgcacctcgagggcaagtgcgagacctgcgtctacaacatgatggggaagcgggagaagaagctgggcgagttcggcaaggccaaggggagccgcgccatctggtacatgtggctgggcgcgcggttcctcgagttcgaggccctggggttcctgaacgaggaccactggttctcccgcggcaacagcctcagcggggtggagggcgagggcctgcaccggctggggtacatcctccgcgacgtcggcaagaaggagggcggcgccatgtacgccgacgacacggccgggtgggacacccggatcaccctggaggacctgaagaacgaggagatggtgaccaaccacatgaagggcgagcacaagaagctcgcggaggccatcttcaagctgacgtaccagaacaaggtggtccgcgtgcagcggccgacgccccgcggcaccgtgatggacatcatctcccggcgcgaccagcgcgggagcggccaggtcgggacctacggcctgaacacgttcaccaacatggaggcccagctcatccggcagatggagggcgaggggatcttcaagtccatccagcacctgaccgccaccgaggagatcgccgtgcagaactggctggcgcgcgtgggccgggagcgcctcagccggatggccatctccggggacgactgcgtcgtgaagcccatcgacgaccgcttcgccagcgccctgacggccctgaacgacatgggcaaggtgcggaaggacatccagcagtgggagccctcccgcgggtggaacgactggacccaggtcccgttctgcagccaccacttccacgagctcgtgatgaaggacggccgggtgctggtcgtgccctgccgcaaccaggacgagctgatcggccgggcgcgcatctcccagggggccggctggagcctcaaggagaccgcctgcctggggaagtcctacgcccagatgtggaccctgatgtacttccaccggcgcgacctccggctggccgcgaacgccatctgcagcgccgtgccctcccactgggtccccaccagccgcacgacctggtccatccacgccaagcacgagtggatgaccaccgaggacatgctggcggtgtggaaccgggtgtggatccaggagaacccgtggatggaggacaagacgcccgtcgagagctgggaggaggtgccctacctcggcaagcgcgaggaccagtggtgcgggtccctgatcggcctgaccagccgggccacctgggccaagaacatccagaccgccatcaaccaggtgcgcagcctcatcggcaacgaggagtacacggactacatgccctccatgaagcgcttccggcgcgaggaggaggaggccggggtcctgtggtga

SEQ ID NO: 9484 - RNA, 9876 nt, synthetic construct
  misc_feature 1..9876: note = derived and/or modified CDS sequence (opt1) from DENV-2__FJ850105__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggccgagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggcgctccaccaggtgttcggggccatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggcgatggtgcaggccgactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggcgggcaagcggagcctgcgcccgcagcccaccgagctgaagtactcctggaagacgtggggcaaggccaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgcgatcaaggacaaccgggccgtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgcggggcccgtgtcccagcacaactaccgcccgggctaccacacgcagaccgccgggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggcgctgttcctcgaggagatgctgcggacccgcgtgggcacgaagcacgccatcctgctcgtcgccgtgagcttcgtgaccctgatcaccgggaacatgtccttccgggacctgggccgcgtcatggtgatggtgggggccaccatgacggacgacatcggcatgggcgtcacctacctcgccctgctggcggccttcaaggtgcgccccaccttcgccgccgggctcctgctgcggaagctcaccagcaaggagctgatgatggccacgatcggcatcaccctgctctcccagagcaccatccccgagaccatcctggagctgacggacgcgctcgccctggggatgatggtgctgaagatcgtccgcaacatggagaagtaccagctcgccgtgaccatcatggccatctcctgcgtgccgaacgccgtcatcctgcggaacgcgtggaaggtgagctgcaccatcctggccgccgtgtccgtcagccccctcctgctgacctccagccagcagaaggccgactggatccccctcgcgctgacgatcaagggcctgaaccccaccgccatcttcctcaccaccctgtcccgcacgagcaagaagcggtcctggccgctgaacgaggccatcatggccgtgggcatggtcagcatcctcgcctccagcctgctgaagaacgacatccccatgaccgggcccctcgtggcgggcgggctgctgaccgtgtgctacgtcctcaccggccgcagcgccgacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtgatcagcggggtcttcccggtgtccatccccatcaccgcggccgcctggtacctgtgggaggtgaagaagcagcgggccggcgtcctctgggacgtgcccagcccgccgcccgtggggaaggccgagctggaggacggcgcgtaccgcatcaagcagcgggggatcctgggctactcccagatcggcgccggggtctacaaggagggcacgttccacaccatgtggcacgtgacccgcggggccgtgctcatgcaccggggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcatcttcaagacgaacaccgggaccatcggcgccgtgagcctggacttctcccccggcaccagcgggtcccccatcgtggaccgcaagggcaaggtcgtggggctctacggcaacggcgtggtcacgcggagcggggcctacgtgtccgccatcgcgcagaccgagaagtccatcgaggacaaccccgagatcgaggacgacatcttccgcaagaagcggctgaccatcatggacctgcaccccggcgccgggaagaccaagcgctacctccccgccatcgtgcgggaggccatcaagcgcggcctgcgcacgctgatcctggccccgacccgggtcgtggcggccgagatggaggaggccctccgcgggctgcccatccggtaccagacccccgccatcaaggccgagcacaccggccgcgagatcgtggacctgatgtgccacgcgacgttcaccatgcggctcctgagccccgtccgcgtgccgaactacaacctgatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctccgcaagaacggcaagaaggtcatccagctgagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctgacggacggcgaggagcgcgtcatcctcgccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgcgagaaggtggacgccatcgacggggagtaccggctgcgcggcgaggcccggaagaccttcgtcgacctgatgcgccgcggggacctccccgtgtggctggcctacaaggtggccgcggagggcatcaactacgccgaccgcaagtggtgcttcgacgggatcaagaacaaccagatcctggaggagaacgtcgaggtggagatctggacgaaggagggcgagcggaagaagctcaagccgcgctggctggacgcccggatctacagcgaccccctggccctcaaggagttcaaggagttcgcggccggccgcaagtccctgaccctgaacctcatcaccgagatggggcggctgcccaccttcatgacgcagaaggcccgcaacgccctggacaacctcgccgtgctgcacaccgcggaggccggcgggcgggcctacaaccacgccctgagcgagctccccgagaccctggagaccctgctcctgctgacgctcctggccaccgtcaccggcggcatcttcctgttcctcatgtccgggaagggcatcgggaagatgaccctgggcatgtgctgcatcatcaccgcgagcgtgctgctctggtacgcccagatccagccgcactggatcgccgcctccatcatcctggagttcttcctgatcgtcctcctgatccccgagcccgagaagcagcgcacgccccaggacaaccagctgacctacgtggtgatcgccatcctcaccgtcgtggcggccaccatggccaacgagatggggttcctggagaagacgaagaaggacctgggcctcggcagcatcaccacccaggagagcgagtccaacatcctggacatcgacctgcggccggccagcgcctggaccctctacgcggtggccacgaccttcgtcacccccatgctgcgccactccatcgagaacagctccgtgaacgtgagcctgaccgccatcgccaaccaggcgacggtcctcatggggctgggcaaggggtggcccctgtccaagatggacatcggcgtgcccctcctggccatcgggtgctacagccaggtgaacccgatcaccctgaccgccgccctcctgctgctcgtcgcccactacgcgatcatcggccccggcctgcaggccaaggccacccgggaggcccagaagcgcgccgcggccgggatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcggaccacgtgggccctgtgcgaggccctcaccctggccaccggccccatctccaccctgtgggaggggaaccccggccgcttctggaacacgaccatcgcggtcagcatggccaacatcttccgcggctcctacctcgccggggccggcctgctgttcagcatcatgaagaacaccaccaacacgcggcgcgggaccggcaacatcggcgagaccctcggggagaagtggaagtcccggctgaacgcgctgggcaagagcgagttccagatctacaagaagtccgggatccaggaggtggaccgcaccctcgccaaggagggcatcaagcgcggggagacggaccaccacgccgtgagccgcggctccgccaagctgcggtggttcgtcgagcgcaacatggtgaccccggagggcaaggtggtcgacctggggtgcggccgcgggggctggagctactactgcgggggcctcaagaacgtgcgcgaggtgaagggcctgaccaagggcggccccgggcacgaggagcccatccccatgtccacctacggctggaacctggtccggctccagagcggggtggacgtgttcttcacgccgcccgagaagtgcgacaccctgctgtgcgacatcggcgagagctcccccaaccccaccatcgaggccggccgcaccctccgggtcctgaacctggtggagaactggctcaacaacaacacccagttctgcatcaaggtgctgaacccgtacatgcccagcgtcatcgagaagatggagacgctgcagcgcaagtacgggggcgcgctcgtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacgtacgagccggacgtggacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtcaacggggtggtgcgcctgctgaccaagccctgggacgtcgtgccgatggtgacccagatggcgatgacggacaccacccccttcggccagcagcgggtcttcaaggagaaggtggacacccgcacgcaggagcccaaggagggcaccaagaagctcatgcggatcaccgccgagtggctgtggaaggagctggggaagaagaagacgccccggatgtgcacgcgggaggagttcacccgcaaggtgcggagcaacgccgccctcggcgccatcttcaccgacgagaacaagtggaagtccgcgcgcgaggccgtcgaggacgggcggttctgggagctggtggacaaggagcgcaacctgcacctcgagggcaagtgcgagacctgcgtgtacaacatgatggggaagcgggagaagaagctgggcgagttcggcaaggccaaggggagccgcgccatctggtacatgtggctgggcgcgcggttcctcgagttcgaggccctggggttcctgaacgaggaccactggttctcccgcggcaacagcctcagcggggtcgagggcgagggcctgcaccggctggggtacatcctccgcgacgtgggcaagaaggagggcggcgccatgtacgccgacgacacggccgggtgggacacccggatcaccctggaggacctgaagaacgaggagatggtcaccaaccacatgaagggcgagcacaagaagctcgcggaggccatcttcaagctgacgtaccagaacaaggtggtgcgcgtccagcggccgacgccccgcggcaccgtgatggacatcatctcccggcgcgaccagcgcgggagcggccaggtggggacctacggcctgaacacgttcaccaacatggaggcccagctcatccggcagatggagggcgaggggatcttcaagtccatccagcacctgaccgccaccgaggagatcgccgtccagaactggctggcgcgcgtgggccgggagcgcctcagccggatggccatctccggggacgactgcgtggtcaagcccatcgacgaccgcttcgccagcgccctgacggccctgaacgacatgggcaaggtgcggaaggacatccagcagtgggagccctcccgcgggtggaacgactggacccaggtgccgttctgcagccaccacttccacgagctcgtcatgaaggacggccgggtgctggtggtcccctgccgcaaccaggacgagctgatcggccgggcgcgcatctcccagggggccggctggagcctcaaggagaccgcctgcctggggaagtcctacgcccagatgtggaccctgatgtacttccaccggcgcgacctccggctggccgcgaacgccatctgcagcgccgtgccctcccactgggtgcccaccagccgcacgacctggtccatccacgccaagcacgagtggatgaccaccgaggacatgctggcggtctggaaccgggtgtggatccaggagaacccgtggatggaggacaagacgcccgtggagagctgggaggaggtcccctacctcggcaagcgcgaggaccagtggtgcgggtccctgatcggcctgaccagccgggccacctgggccaagaacatccagaccgccatcaaccaggtgcgcagcctcatcggcaacgaggagtacacggactacatgccctccatgaagcgcttccggcgcgaggaggaggaggccggggtgctgtggtga

SEQ ID NO: 9485 - RNA, 9876 nt, synthetic construct
  misc_feature 1..9876: note = derived and/or modified CDS sequence (opt1) from DENV-2__FJ850106__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgaccctgctcgtggccgccagcttcgtgaccctgatcaccgggaacatgtccttccgggacctgggccgcgtcatggtgatggtgggggccacgatgaccgacgacatcggcatgggcgtcacctacctcgccctgctggcggccttcaaggtgcgccccaccttcgccgccgggctcctgctgcggaagctcacgagcaaggagctgatgatggccaccatcggcatcaccctgctctcccagagcaccatccccgagacgatcctggagctgaccgacgcgctcgccctggggatgatggtgctgaagatcgtccgcaacatggagaagtaccagctcgccgtgaccatcatggccatctcctgcgtgccgaacgccgtcatcctgcggaacgcgtggaaggtgagctgcaccatcctggccgccgtgtccgtcagccccctcctgctgacgtccagccagcagaaggccgactggatccccctcgcgctgaccatcaagggcctgaaccccaccgccatcttcctcaccacgctgtcccgcaccagcaagaagcggtcctggccgctgaacgaggccatcatggccgtgggcatggtcagcatcctcgcctccagcctgctgaagaacgacatccccatgaccgggcccctcgtggcgggcgggctgctgaccgtgtgctacgtcctcacgggccgcagcgccgacctggagctggagcgggccgccgacgtgaagtgggaggaccaggccgagatctccgggagctcccccatcctcagcatcaccatctccgaggacggcagcatgtccatcaagaacgaggaggaggagcagaccctgaccatcctgatccgcaccggcctcctggtgatcagcggggtcttcccggtgtccatccccatcacggcggccgcctggtacctgtgggaggtgaagaagcagcgggccggcgtcctctgggacgtgcccagcccgccgcccgtggggaaggccgagctggaggacggcgcgtaccgcatcaagcagcgggggatcctgggctactcccagatcggcgccggggtctacaaggagggcaccttccacaccatgtggcacgtgacccgcggggccgtgctcatgcaccggggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagacgaagcccggcatcttcaagaccaacaccgggaccatcggcgccgtgagcctggacttctcccccggcacgagcgggtcccccatcgtggaccgcaagggcaaggtcgtggggctctacggcaacggcgtggtcacccggagcggggcctacgtgtccgccatcgcgcagaccgagaagtccatcgaggacaaccccgagatcgaggacgacatcttccgcaagaagcggctgaccatcatggacctgcaccccggcgccgggaagacgaagcgctacctccccgccatcgtgcgggaggccatcaagcgcggcctgcgcaccctgatcctggccccgacccgggtcgtggcggccgagatggaggaggccctccgcgggctgcccatccggtaccagacccccgccatcaaggccgagcacacgggccgcgagatcgtggacctgatgtgccacgcgaccttcaccatgcggctcctgagccccgtccgcgtgccgaactacaacctgatcatcatggacgaggcccacttcaccgaccccgcctccatcgccgcccggggctacatcagcacgcgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtcaccgacttcaaggggaagacggtgtggttcgtgccgtccatcaaggcgggcaacgacatcgccgcctgcctccgcaagaacggcaagaaggtcatccagctgagccggaagaccttcgactccgagtacgtgaagacccgcgccaacgactgggacttcgtggtcaccacggacatcagcgagatgggggccaacttcaaggcggagcgggtgatcgacccccgccggtgcatgaagcccgtgatcctgaccgacggcgaggagcgcgtcatcctcgccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgcgagaaggtggacgccatcgacggggagtaccggctgcgcggcgaggcccggaagacgttcgtcgacctgatgcgccgcggggacctccccgtgtggctggcctacaaggtggccgcggagggcatcaactacgccgaccgcaagtggtgcttcgacgggatcaagaacaaccagatcctggaggagaacgtcgaggtggagatctggaccaaggagggcgagcggaagaagctcaagccgcgctggctggacgcccggatctacagcgaccccctggccctcaaggagttcaaggagttcgcggccggccgcaagtccctgaccctgaacctcatcaccgagatggggcggctgcccacgttcatgacccagaaggcccgcaacgccctggacaacctcgccgtgctgcacaccgcggaggccggcgggcgggcctacaaccacgccctgagcgagctccccgagaccctggagacgctgctcctgctgaccctcctggccaccgtcaccggcggcatcttcctgttcctcatgtccgggaagggcatcgggaagatgaccctgggcatgtgctgcatcatcacggcgagcgtgctgctctggtacgcccagatccagccgcactggatcgccgcctccatcatcctggagttcttcctgatcgtcctcctgatccccgagcccgagaagcagcgcacgccccaggacaaccagctgacctacgtggtgatcgccatcctcaccgtcgtggcggccacgatggccaacgagatggggttcctggagaagaccaagaaggacctgggcctcggcagcatcaccacccaggagagcgagtccaacatcctggacatcgacctgcggccggccagcgcctggacgctctacgcggtggccaccaccttcgtcacccccatgctgcgccactccatcgagaacagctccgtgaacgtgagcctgacggccatcgccaaccaggcgaccgtcctcatggggctgggcaaggggtggcccctgtccaagatggacatcggcgtgcccctcctggccatcgggtgctacagccaggtgaacccgatcaccctgaccgccgccctcctgctgctcgtcgcccactacgcgatcatcggccccggcctgcaggccaaggccacgcgggaggcccagaagcgcgccgcggccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcggacgacctgggccctgtgcgaggccctcaccctggccaccggccccatctccacgctgtgggaggggaaccccggccgcttctggaacaccaccatcgcggtcagcatggccaacatcttccgcggctcctacctcgccggggccggcctgctgttcagcatcatgaagaacaccacgaacacccggcgcgggaccggcaacatcggcgagaccctcggggagaagtggaagtcccggctgaacgcgctgggcaagagcgagttccagatctacaagaagtccgggatccaggaggtggaccgcacgctcgccaaggagggcatcaagcgcggggagaccgaccaccacgccgtgagccgcggctccgccaagctgcggtggttcgtcgagcgcaacatggtgaccccggagggcaaggtggtcgacctggggtgcggccgcgggggctggagctactactgcgggggcctcaagaacgtgcgcgaggtgaagggcctgaccaagggcggccccgggcacgaggagcccatccccatgtccacgtacggctggaacctggtccggctccagagcggggtggacgtgttcttcaccccgcccgagaagtgcgacaccctgctgtgcgacatcggcgagagctcccccaaccccaccatcgaggccggccgcaccctccgggtcctgaacctggtggagaactggctcaacaacaacacgcagttctgcatcaaggtgctgaacccgtacatgcccagcgtcatcgagaagatggagaccctgcagcgcaagtacgggggcgcgctcgtgcggaaccccctgtcccgcaacagcacccacgagatgtactgggtgtccaacgccaccgggaacatcgtcagctccgtgaacatgatcagccggatgctgatcaaccgcttcacgatgaagcacaagaaggccacctacgagccggacgtggacctgggctccgggacccggaacatcggcatcgagagcgagatccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtcaacggggtggtgcgcctgctgaccaagccctgggacgtcgtgccgatggtgacgcagatggcgatgaccgacaccacccccttcggccagcagcgggtcttcaaggagaaggtggacacgcgcacccaggagcccaaggagggcaccaagaagctcatgcggatcaccgccgagtggctgtggaaggagctggggaagaagaagacgccccgcatgtgcacccgggaggagttcacccgcaaggtgcggagcaacgccgccctcggcgccatcttcaccgacgagaacaagtggaagtccgcgcgcgaggccgtcgaggacgggcggttctgggagctggtggacaaggagcgcaacctgcacctcgagggcaagtgcgagacgtgcgtgtacaacatgatggggaagcgggagaagaagctgggcgagttcggcaaggccaaggggagccgcgccatctggtacatgtggctgggcgcgcggttcctcgagttcgaggccctggggttcctgaacgaggaccactggttctcccgcggcaacagcctcagcggggtcgagggcgagggcctgcaccggctggggtacatcctccgcgacgtgggcaagaaggagggcggcgccatgtacgccgacgacaccgccgggtgggacacccggatcaccctggaggacctgaagaacgaggagatggtcacgaaccacatgaagggcgagcacaagaagctcgcggaggccatcttcaagctgacctaccagaacaaggtggtgcgcgtccagcggccgacgccccggggcaccgtgatggacatcatctcccggcgcgaccagcgcgggagcggccaggtggggacgtacggcctgaacaccttcaccaacatggaggcccagctcatccggcagatggagggcgaggggatcttcaagtccatccagcacctgaccgccacggaggagatcgccgtccagaactggctggcgcgcgtgggccgggagcgcctcagccggatggccatctccggggacgactgcgtggtcaagcccatcgacgaccgcttcgccagcgccctgaccgccctgaacgacatgggcaaggtgcggaaggacatccagcagtgggagccctcccgcgggtggaacgactggacccaggtgccgttctgcagccaccacttccacgagctcgtcatgaaggacggccgggtgctggtggtcccctgccgcaaccaggacgagctgatcggccgggcgcgcatctcccagggggccggctggagcctcaaggagaccgcctgcctggggaagtcctacgcccagatgtggaccctgatgtacttccaccggcgcgacctccggctggccgcgaacgccatctgcagcgccgtgccctcccactgggtgcccacgagccgcaccacctggtccatccacgccaagcacgagtggatgaccacggaggacatgctggcggtctggaaccgggtgtggatccaggagaacccgtggatggaggacaagacccccgtggagagctgggaggaggtcccctacctcggcaagcgcgaggaccagtggtgcgggtccctgatcggcctgaccagccgggccacctgggccaagaacatccagacggccatcaaccaggtgcgcagcctcatcggcaacgaggagtacaccgactacatgccctccatgaagcgcttccggcgcgaggaggaggaggccggggtgctgtggtga

SEQ ID NO: 9486 - RNA, 9876 nt, synthetic construct
  misc_feature 1..9876: note = derived and/or modified CDS sequence (opt1) from DENV-2__FJ850107__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtcctgaagatcgtgcgcaacatggagaagtaccagctcgccgtgaccatcatggccatctcctgcgtcccgaacgccgtgatcctgcggaacgcctggaaggtgagctgcaccatcctggcggccgtctccgtgttccccctcctgctgaccagctcccagcagaaggccgactggatccccctcgccctgacgatcaagggcctgaaccccaccgcgatcttcctcaccaccctgagccgcacgtccaagaagcggagctggccgctgaacgaggccatcatggccgtcggcatggtgtccatcctcgccagctccctgctgaagaacgacatccccatgaccgggcccctcgtggccggcgggctgctgaccgtctgctacgtgctcaccggccgcagcgcggacctggagctggagcgggccgccgacgtgaagtgggaggaccaggccgagatcagcgggtccagccccatcctctccatcacgatcagcgaggacggctccatgagcatcaagaacgaggaggaggagcagaccctgaccatcctgatccgcaccggcctcctggtcatctccggggtgttcccggtgagcatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctacagccagatcggcgcgggggtgtacaaggagggcacgttccacaccatgtggcacgtgacccgcggggccgtcctcatgcaccggggcaagcgcatcgagccctcctgggccgacgtgaagaaggacctgatcagctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgcggtgtccctggacttcagccccggcacctccgggagccccatcgtcgaccgcaagggcaaggtggtggggctctacggcaacggcgtcgtgacgcggtccggggcctacgtgagcgccatcgcccagaccgagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcacgctgatcctggccccgacccgggtggtggccgcggagatggaggaggccctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcgcacttcaccgaccccgccagcatcgccgcccggggctacatctccacccgcgtcgagatgggggaggccgcgggcatcttcatgacggccacgccgcccgggagccgggacccgttcccccagtccaacgcccccatcatggacgaggagcgcgagatccccgagcggagctggaactccggccacgagtgggtgaccgacttcaaggggaagaccgtgtggttcgtcccgagcatcaaggccggcaacgacatcgcggcctgcctccgcaagaacggcaagaaggtgatccagctgtcccggaagacgttcgacagcgagtacgtgaagacccgcgccaacgactgggacttcgtcgtgaccaccgacatctccgagatgggggccaacttcaaggccgagcgggtgatcgacccccgccggtgcatgaagcccgtcatcctgacggacggcgaggagcgcgtgatcctcgcggggcccatgccggtgacccacagctccgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgagcatgttcgagcccgagcgcgagaaggtcgacgcgatcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtggagatctggacgaaggagggcgagcggaagaagctcaagccgcgctggctggacgcccggatctactccgaccccctggccctcaaggagttcaaggagttcgccgcgggccgcaagagcctgaccctgaacctcatcaccgagatggggaagctgcccaccttcatgacgcagaaggcccggaacgccctggacaacctcgccgtcctgcacaccgccgaggcgggcgggcgcgcctacaaccacgccctgtccgagctccccgagaccctggagaccctgctcctgctgacgctcctggccaccgtgaccggcggcatcttcctgttcctcatgagcgggaagggcatcgggaagatgaccctgggcatgtgctgcatcatcaccgcctccgtcctgctctggtacgcgcagatccagccgcactggatcgccgccagcatcatcctggagttcttcctgatcgtgctcctgatccccgagcccgagaagcagcggacgccccaggacaaccagctgacctacgtggtcatcgccatcctcaccgtggtggccgcgaccatggccaacgagatggggttcctggagaagacgaagaaggacctgggcctcggctccatcaccacccaggagagcgagagcaacatcctggacatcgacctgcgcccggcctccgcctggaccctctacgccgtcgcgacgaccttcgtgacccccatgctgcggcacagcatcgagaactccagcgtgaacgtctccctgaccgccatcgccaaccaggccacggtgctcatggggctgggcaaggggtggcccctgagcaagatggacatcggcgtgcccctcctggcgatcgggtgctactcccaggtcaacccgatcaccctgaccgccgccctcctgctgctcgtggcccactacgccatcatcggccccggcctgcaggcgaaggccacccgcgaggcccagaagcgggccgccgcggggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcgcaccacgtgggccctgtgcgaggccctcaccctggccaccggccccatcagcaccctgtgggaggggaaccccggccggttctggaacacgaccatcgccgtgtccatggcgaacatcttccgcggcagctacctcgccggggccggcctgctgttctccatcatgaagaacaccaccaacacgcgccgggggaccggcaacatcggcgagaccctcggggagaagtggaagtcccgcctgaacgccctgggcaagtccgagttccagatctacaagaagtccgggatccaggaggtggaccggaccctcgcgaaggagggcatcaagcgcggggagacggaccaccacgccgtctcccggggcagcgccaagctgcgctggttcgtggagcggaacatggtgaccccggagggcaaggtcgtggacctggggtgcggccgcgggggctggtcctactactgcgggggcctcaagaacgtgcgggaggtcaagggcctgaccaagggcgggcccgggcacgaggagcccatccccatgagcacctacggctggaacctggtgcgcctccagtccggggtggacgtcttcttcacgccgcccgagaagtgcgacaccctgctgtgcgacatcggcgagagcagccccaaccccaccatcgaggccggccggaccctccgcgtgctgaacctggtggagaactggctcaacaacaacacccagttctgcatcaaggtcctgaacccgtacatgccctccgtgatcgagaagatggagacgctgcagcggaagtacgggggcgccctcgtgcgcaaccccctgagccggaactccacccacgagatgtactgggtcagcaacgcgaccgggaacatcgtgtccagcgtgaacatgatctcccgcatgctgatcaaccggttcaccatgaagcacaagaaggccacgtacgagccggacgtcgacctgggcagcgggacccgcaacatcggcatcgagtccgagatccccaacctcgacatcatcggcaagcggatcgagaagatccgccaggagcacgagaccagctggcactacgaccaggaccacccctacaagacctgggcctaccacgggtcctacgagacgaagcagaccggcagcgcctccagcatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgcggagtggctgtggaaggagctggggaagaagaagacgccccgcatgtgcacgcgggaggagttcacccgcaaggtccggtccaacgccgccctcggcgccatcttcaccgacgagaacaagtggaagtccgcccgcgaggcggtggaggacgggcggttctgggagctggtggacaaggagcgcaacctgcacctcgagggcaagtgcgagacctgcgtctacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcggcaactccctcagcggggtggagggcgagggcctgcaccggctggggtacatcctccgcgacgtcggcaagaaggagggcggggccatgtacgccgacgacacggccgggtgggacacccggatcaccctggaggacctgaagaacgaggagatggtgaccaaccacatgaagggcgagcacaagaagctcgccgaggcgatcttcaagctgacgtaccagaacaaggtggtccgcgtgcagcggccgacgccccgcggcaccgtgatggacatcatcagccggcgcgaccagcgcgggtccggccaggtcgggacctacggcctgaacacgttcaccaacatggaggcccagctcatccggcagatggagggcgaggggatcttcaagagcatccagcacctgaccgccaccgaggagatcgccgtgcagaactggctggcccgcgtgggccgggagcgcctctcccggatggcgatcagcggggacgactgcgtcgtgaagcccatcgacgaccgcttcgcctccgccctgacggccctgaacgacatgggcaaggtgcggaaggacatccagcagtgggagcccagccgcgggtggaacgactggacccaggtcccgttctgctcccaccacttccacgagctcgtgatgaaggacggccgggtgctggtcgtgccctgccgcaaccaggacgagctgatcggccgggcccgcatcagccagggggcgggctggtccctcaaggagaccgcctgcctgggcaagagctacgcccagatgtggaccctgatgtacttccaccggcgcgacctccggctggccgccaacgcgatctgctccgccgtgcccagccactgggtccccacctcccgcacgacctggagcatccacgccaagcacgagtggatgaccaccgaggacatgctggccgtgtggaaccgggtgtggatccaggagaacccgtggatggaggacaagacgcccgtcgagtcctgggaggaggtgccctacctcggcaagcgcgaggaccagtggtgcgggagcctgatcggcctgacctcccgggcgacctgggccaagaacatccagaccgccatcaaccaggtgcgcagcctcatcggcaacgaggagtacacggactacatgcccagcatgaagcgcttccggcgcgaggaggaggaggccggggtcctgtggtga

SEQ ID NO: 9487 - RNA, 9876 nt, synthetic construct
  misc_feature 1..9876: note = derived and/or modified CDS sequence (opt1) from DENV-2__FJ850108__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagcagcgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagatcgcggggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcgtgggcaccaagcacgcgatcctgctcgtcgccgtgagcttcgtgacgctgatcaccgggaacatgtccttccgggacctgggccgcatgatggtcatggtgggggccaccatgaccgacgacatcggcatgggcgtgacgtacctcgccctgctggccgcgttcaaggtccgccccaccttcgtggccgggctcctgctgcggaagctcaccagcaaggagctgatgatggccaccatcggcatcacgctgctctcccagagcaccatccccgagaccatcctggagctgaccgacgccctcgccctggggatgatggtgctgaagatcgtccgcaacatggagaagtaccagctcgcggtgacgatcatggccatctcctgcgtgccgaacgccgtcatcctgcggaacgcctggaaggtgagctgcaccatcctggccgcggtctccgtgagccccctcctgctgacctccagccagcagaaggccgactggatccccctcgccctgaccatcaagggcctgaaccccacggccatcttcctcaccaccctgtcccgcaccagcaagaagcggtcctggccgctgaacgaggcgatcatggccgtgggcatggtcagcatcctcgcctccagcctgctgaagaacgacatccccatgacggggcccctcgtggccggcgggctgctgaccgtgtgctacgtcctcaccggccgcagcgccgacctggagctggagcgggcggccgacgtgaagtgggaggaccaggccgagatctccgggagctcccccatcctcagcatcaccatctccgaggacggcagcatgtccatcaagaacgaggaggaggagcagacgctgaccatcctgatccgcaccggcctcctggtgatcagcggggtcttcccggtgtccatccccatcaccgccgccgcgtggtacctgtgggaggtgaagaagcagcgggccggcgtcctctgggacgtgcccagcccgccgcccgtggggaaggccgagctggaggacggcgcctaccgcatcaagcagcgggggatcctgggctactcccagatcggcgccggggtctacaaggagggcaccttccacacgatgtggcacgtgacccgcggggcggtgctcatgcaccggggcaagcgcatcgagcccagctgggccgacgtcaagaaggacctgatctcctacgggggcggctggaagctggagggggagtggaaggagggcgaggaggtccaggtgctcgccctggagcccgggaagaacccccgggccgtccagaccaagcccggcatcttcaagaccaacacggggaccatcggcgccgtgagcctggacttctcccccggcaccagcgggtcccccatcgtggaccgcaagggcaaggtcgtggggctctacggcaacggcgtggtcacccggagcggggcgtacgtgtccgccatcgcccagacggagaagtccatcgaggacaaccccgagatcgaggacgacatcttccgcaagaagcggctgaccatcatggacctgcaccccggcgccgggaagaccaagcgctacctccccgcgatcgtgcgggaggccatcaagcgcggcctgcgcaccctgatcctggccccgacgcgggtcgtggccgccgagatggaggaggcgctccgcgggctgcccatccggtaccagacccccgccatcaaggccgagcacaccggccgcgagatcgtggacctgatgtgccacgccaccttcacgatgcggctcctgagccccgtccgcgtgccgaactacaacctgatcatcatggacgaggcccacttcaccgaccccgcgtccatcgccgcccggggctacatcagcacccgcgtggagatgggggaggccgccggcatcttcatgaccgcgacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggccggcaacgacatcgccgcgtgcctccgcaagaacggcaagaaggtcatccagctgagccggaagaccttcgactccgagtacgtgaagacgcgcgccaacgactgggacttcgtggtcaccaccgacatcagcgagatgggggccaacttcaaggccgagcgggtgatcgacccccgccggtgcatgaagcccgtgatcctgaccgacggcgaggagcgcgtcatcctcgccgggcccatgccggtgacgcactccagcgcggcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtggacgccatcgacggggagtaccggctgcgcggcgaggcgcggaagaccttcgtcgacctgatgcgccgcggggacctccccgtgtggctggcctacaaggtggccgccgagggcatcaactacgccgaccgcaagtggtgcttcgacgggatcaagaacaaccagatcctggaggagaacgtcgaggtggagatctggaccaaggagggcgagcggaagaagctcaagccgcgctggctggacgcgcggatctacagcgaccccctggccctcaaggagttcaaggagttcgccgccggccgcaagtccctgacgctgaacctcatcaccgagatggggcggctgcccaccttcatgacccagaaggcgcgcaacgccctggacaacctcgccgtcctgcacacggccgaggccggcgggcgggcgtacaaccacgccctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgccagcgtgctgctctggtacgcccagatccagccgcactggatcgcggcctccatcatcctggagttcttcctgatcgtcctcctgatccccgagcccgagaagcagcgcacgccccaggacaaccagctgacgtacgtggtgatcgccatcctcaccgtcgtggccgccaccatggcgaacgagatggggttcctggagaagaccaagaaggacctgggcctcggcagcatcacgacccaggagccggagagcaacatcctggacatcgacctgcggcccgcctccgcctggaccctctacgccgtggccaccacgttcgtcacccccatgctgcgccacagcatcgagaactccagcgtgaacgtgtccctgaccgcgatcgccaaccaggccaccgtcctcatggggctgggcaaggggtggcccctgagcaagatggacatcggcgtgccgctcctggccatcgggtgctactcccaggtgaaccccatcacgctgaccgcggccctcctgctgctcgtcgcccactacgccatcatcggccccggcctgcaggccaaggcgacccgggaggcccagaagcgcgccgccgccgggatcatgaagaaccccaccgtggacggcatcacggtgatcgacctggagccgatcccctacgaccccaagttcgagaagcagctcgggcaggtcatgctgctgatcctctgcgtgacccaggtgctgatgatgcggaccacctgggcgctgtgcgaggccctcacgctggccaccggccccatcagcaccctgtgggaggggaacccgggccgcttctggaacaccacgatcgccgtctccatggccaacatcttccgcggcagctacctcgcgggggccggcctgctgttctccatcatgaagaacaccaccaacacccggcgcgggacgggcaacatcggcgagaccctcggggagaagtggaagtcccggctgaacgccctgggcaagtccgagttccagatctacaagaagtccgggatccaggaggtggaccgcaccctcgccaaggagggcatcaagcgcggggagaccgaccaccacgcggtgtcccgcggcagcgccaagctgcggtggttcgtcgagcgcaacatggtgacgcccgagggcaaggtggtcgacctggggtgcggccgcggcgggtggtcctactactgcggcgggctcaagaacgtgcgcgaggtgaaggggctgaccaagggcggccccgggcacgaggagcccatcccgatgagcacctacggctggaacctggtccggctccagtccggggtggacgtgttcttcacgccgcccgagaagtgcgacacgctgctgtgcgacatcggcgagagcagccccaacccgaccatcgaggccggccgcaccctccgggtcctgaacctggtggagaactggctcaacaacaacacccagttctgcatcaaggtgctgaacccctacatgccctccgtcatcgagaagatggagaccctgcagcgcaagtacgggggcgccctcgtgcggaacccgctgagccgcaactccacgcacgagatgtactgggtgagcaacgccaccgggaacatcgtctccagcgtgaacatgatctcccggatgctgatcaaccgcttcaccatgaagcacaagaaggcgacctacgagcccgacgtggacctgggcagcgggacgcggaacatcggcatcgagtccgagatccccaacctcgacatcatcggcaagcgcatcgagaagatcaagcaggagcacgagaccagctggcactacgaccaggaccacccctacaagacctgggcctaccacgggtcctacgagaccaagcagacgggcagcgcctccagcatggtcaacggggtggtgcgcctgctgaccaagccgtgggacgtcgtgcccatggtgacccagatggccatgaccgacacgacccccttcggccagcagcgggtcttcaaggagaaggtggacacccgcacccaggagcccaaggagggcacgaagaagctcatgcggatcaccgccgagtggctgtggaaggagctggggaagaagaagaccccgcgcatgtgcacccgggaggagttcacgcgcaaggtgcggtccaacgcggccctcggcgccatcttcaccgacgagaacaagtggaagtccgcccgcgaggccgtcgaggacgggcggttctgggagctggtggaccgcgagcggaacctgcacctcgagggcaagtgcgagacctgcgtctacaacatgatggggaagcgcgagaagaagctgggcgagttcggcaaggcgaaggggtcccgggccatctggtacatgtggctgggcgcccgcttcctcgagttcgaggccctggggttcctgaacgaggaccactggttcagccggggcaactccctcagcggggtggagggcgagggcctgcaccgcctggggtacatcctccgggacgtgggcaagaaggagggcggcgcgatgtacgccgacgacaccgccgggtgggacacgcgcatcaccctggaggacctgaagaacgaggagatggtcaccaaccacatgaagggcgagcacaagaagctcgccgaggccatcttcaagctgacctaccagaacaaggtggtgcgggtccagcgccccacgccccggggcaccgtgatggacatcatcagccgccgcgaccagcgggggtccggccaggtggggacctacggcctgaacaccttcacgaacatggaggcgcagctcatccgccagatggagggcgaggggatcttcaagagcatccagcacctgaccgtcaccgaggagatcgccgtgcagaactggctggcccgggtgggccgcgagcggctctcccgcatggccatcagcggggacgactgcgtcgtgaagcccatcgacgaccggttcgcctccgcgctgaccgccctgaacgacatgggcaaggtgcgcaaggacatccagcagtgggagccgagccgggggtggaacgactggacgcaggtccccttctgctcccaccacttccacgagctcgtgatgaaggacggccgcgtgctggtcgtgccctgccggaaccaggacgagctgatcggccgcgcccggatcagccagggggccggctggtccctcaaggagaccgcctgcctgggcaagagctacgcgcagatgtggaccctgatgtacttccaccgccgggacctccgcctggccgccaacgccatctgctccgccgtgcccagccactgggtcccgacctcccggaccacgtggagcatccacgcgaagcacgagtggatgaccaccgaggacatgctggccgtgtggaaccgcgtgtggatccaggagaacccctggatggaggacaagacccccgtcgagtcctgggaggaggtgccctacctcggcaagcgggaggaccagtggtgcgggagcctgatcggcctgacgtcccgcgccacctgggccaagaacatccagaccgcgatcaaccaggtgcgcagcctcatcggcaacgaggagtacaccgactacatgccgagcatgaagcggttccgccgggaggaggaggaggccggggtcctgtggtga

SEQ ID NO: 9488 - RNA, 9876 nt, synthetic construct
  misc_feature 1..9876: note = derived and/or modified CDS sequence (opt1) from DENV-2__JN819407__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccacctccacctgggtcacctacgggacctgcaccaccacgggcgagcaccggcgcgagaagcggtccgtggccctggtgccccacgtcgggatgggcctcgagacccggaccgagacctggatgtcctccgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcctgggcaacctcctgttcaccggccacctgaagtgccgcctccggatggacaagctgcagctgaaggggatgagctactccatgtgcaccggcaagttcaagatcgtgaaggagatcgccgagacccagcacgggacgatcgtgatccgcgtccagtacgagggcgacggcagcccctgcaagatccccttcgagatcaccgacctcgagaagcggcacgtgctggggcgcctgatcaccgtgaacccgatcgtcatcgagaaggactcccccgtgaacatcgaggcggagccgcccttcggcgacagctacatcatcatcggggtggagccgggccagctcaagctgaactggttcaagaaggggtccagcatcggccagatgttcgagaccacgatgcgcggcgccaagcggatggccatcctgggggacaccgcctgggacttcggctccctcgggggcgtcttcaccagcatcgggaaggccctgcaccaggtgttcggcgcgatctacggcgccgccttctccggggtgagctggaccatgaagatcctgatcggcgtcgtgatcacgtggatcgggatgaactcccgcagcacctccctgagcgtgtccctcgtcctggtgggcgtggtcaccctgtacctcggggccatggtgcaggcggacagcggctgcgtggtctcctggaagaacaaggagctgaagtgcggcagcgggatcttcatcaccgacaacgtgcacacgtggaccgagcagtacaagttccagcccgagtcccccagcaagctggccagcgccatccagaaggcccacgaggagggcatctgcgggatccggtccgtgacccgcctcgagaacctgatgtggaagcagatcacccccgagctgaaccacatcctcagcgagaacgaggtcaagctgacgatcatgaccggcgacaccaaggggatcatgcaggccggcaagcggtccctgcgcccgcagcccaccgagctcaagtacagctggaagacgtggggcaaggcgaagatgctgttcaccgagtcccacaaccagaccttcctgatcgacgggcccgagaccgccgagtgcccgaacacgaaccgggcctggaacagcctcgaggtggaggactacggcttcggggtgttctccaccaacatctggctgaagctgcgcgagaagcaggacgtcttctgcgacagcaagctcatgtccgccgccatcaaggacaaccgggcggtgcacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagacggcggggccctggcacctgggcaagctggagatggacttcgacttctgcgaggggaccaccgtggtcgtgaccgaggactgcggcaaccggggcccctccctccgcacgaccaccgccagcgggaagctgatcaccgagtggtgctgccggagctgcacgctgcccccgctccgctaccggggcgaggacgggtgctggtacggcatggagatccgccccctgaaggagaaggaggagaacctggtgaactccctcgtcaccgccgggcacggccagatcgacaacttcagcctgggcgtgctggggatggccctcttcctggaggagatgctgcggacccgcgtgggcaccaagcacgcgatcctcctggtcgccgtgtccttcgtgacgctgatcaccgggaacatgagcttccgggacctcggccgcgtcatggtgatggtgggggccaccatgaccgacgacatcggcatgggcgtcacgtacctggccctgctcgccgcgttcaaggtgcgccccaccttcgccgccgggctgctgctccggaagctgacctccaaggagctgatgatggccaccatcggcatcacgctcctgagccagtccaccatccccgagaccatcctggagctcaccgacgccctggcgctggggatgatggtgctcaagatcgtccgcaacatggagaagtaccagctggccgtgacgatcatggccatcagctgcgtgccgaacgccgtcatcctgcggaacgcctggaaggtgtcctgcaccatcctcgcggccgtcagcgtgagccccctgctgctcaccagctcccagcagaaggccgactggatccccctggccctgaccatcaagggcctcaaccccacggcgatcttcctgaccaccctgagccgcacctccaagaagcggagctggccgctcaacgaggccatcatggccgtgggcatggtctccatcctggccagctccctgctcaagaacgacatccccatgacggggcccctggtggccggcgggctgctcaccgtgtgctacgtcctgaccggccgcagcgcggacctggagctcgagcgggccgccgacgtgaagtgggaggaccaggccgagatcagcgggtccagccccatcctgtccatcaccatcagcgaggacggctccatgagcatcaagaacgaggaggaggagcagacgctgaccatcctcatccgcaccggcctgctggtgatctccggggtcttcccggtgagcatccccatcaccgccgcggcctggtacctctgggaggtgaagaagcagcgggccggcgtcctgtgggacgtgcccagcccgccgcccgtggggaaggccgagctggaggacggcgcctaccgcatcaagcagcgggggatcctcggctacagccagatcggcgcgggggtctacaaggagggcaccttccacacgatgtggcacgtgacccgcggggccgtgctgatgcaccggggcaagcgcatcgagccctcctgggccgacgtcaagaaggacctgatcagctacgggggcggctggaagctcgagggggagtggaaggagggcgaggaggtccaggtgctggccctggagcccgggaagaacccccgggccgtccagaccaagcccggcatcttcaagaccaacacggggaccatcggcgcggtgtccctcgacttcagccccggcacctccgggagccccatcgtggaccgcaagggcaaggtcgtggggctgtacggcaacggcgtggtcacccggtccggggcctacgtgagcgccatcgcccagacggagaagtccatcgaggacaaccccgagatcgaggacgacatcttccgcaagaagcggctgaccatcatggacctccaccccggcgcggggaagaccaagcgctacctgcccgccatcgtgcgggaggccatcaagcgcggcctgcgcaccctgatcctcgccccgacgcgggtcgtggccgcggagatggaggaggccctgcgcgggctgcccatccggtaccagacccccgccatcaaggccgagcacaccggccgcgagatcgtggacctcatgtgccacgccaccttcacgatgcggctgctgagccccgtccgcgtgccgaactacaacctcatcatcatggacgaggcgcacttcaccgaccccgccagcatcgccgcccggggctacatctccacccgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagaccgtgtggttcgtgccgagcatcaaggccggcaacgacatcgcggcctgcctgcgcaagaacggcaagaaggtcatccagctgtcccggaagaccttcgacagcgagtacgtgaagacgcgcgccaacgactgggacttcgtggtcaccaccgacatctccgagatgggggccaacttcaaggccgagcgggtgatcgacccccgccggtgcatgaagcccgtgatcctcaccgacggcgaggagcgcgtcatcctggcggggcccatgccggtgacgcacagctccgccgcccagcggcgcggccgcatcgggcggaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgcgagaaggtggacgcgatcgacggggagtaccggctgcgcggcgaggcccggaagaccttcgtcgacctcatgcgccgcggggacctgcccgtgtggctggcctacaaggtggccgccgagggcatcaactacgcggaccgcaagtggtgcttcgacgggatcaagaacaaccagatcctcgaggagaacgtcgaggtggagatctggaccaaggagggcgagcggaagaagctgaagccgcgctggctggacgcccggatctactccgaccccctcgccctgaaggagttcaaggagttcgccgcgggccgcaagagcctgacgctcaacctgatcaccgagatggggcggctgcccaccttcatgacccagaaggcccgcaacgccctcgacaacctggccgtcctgcacacggccgaggcgggcgggcgggcctacaaccacgccctctccgagctgcccgagaccctggagaccctcctgctgctcaccctgctggccacggtgaccggcggcatcttcctcttcctgatgagcgggaagggcatcgggaagatgaccctgggcatgtgctgcatcatcaccgcctccgtgctcctgtggtacgcgcagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatggggttcctggagaagaccaagaaggacctcggcctgggctccatcacgacccaggagccggagagcaacatcctggacatcgacctccggcccgccagcgcctggaccctgtacgccgtggcgaccacgttcgtcacccccatgctgcgccactccatcgagaacagctccgtgaacgtgagcctcaccgccatcgccaaccaggccaccgtcctgatggggctgggcaaggggtggcccctctccaagatggacatcggcgtgccgctgctggcgatcgggtgctacagccaggtgaaccccatcacgctcaccgccgccctgctgctcctggtcgcccactacgccatcatcggccccggcctgcaggcgaaggccacccgggaggcccagaagcgcgccgccgcggggatcatgaagaaccccaccgtggacggcatcacggtgatcgacctcgagccgatcccctacgaccccaagttcgagaagcagctggggcaggtcatgctgctcatcctgtgcgtgacccaggtgctgatgatgcggaccacctgggccctctgcgaggccctgacgctggccaccggccccatctccaccctctgggaggggaacccgggccgcttctggaacaccacgatcgccgtcagcatggcgaacatcttccgcggctcctacctggccggggccggcctcctcttcagcatcatgaagaacaccaccaacacccggcgcgggacgggcaacatcggcgagaccctgggggagaagtggaagtcccggctgaacgccctcggcaagagcgagttccagatctacaagaagtccgggatccaggaggtggaccgcaccctggcgaaggagggcatcaagcgcggggagaccgaccaccacgccgtgagccgcggctccgccaagctgcggtggttcgtcgagcgcaacatggtgacgcccgagggcaaggtggtcgacctcgggtgcggccgcggcgggtggagctactactgcggcgggctgaagaacgtgcgcgaggtgaaggggctgaccaagggcgggcccgggcacgaggagcccatcccgatgtccacctacggctggaacctcgtccggctgcagagcggggtggacgtgttcttcacgccgcccgagaagtgcgacacgctgctctgcgacatcggcgagtccagccccaacccgaccatcgaggccggccgcaccctgcgggtcctgaacctcgtggagaactggctgaacaacaacacccagttctgcatcaaggtgctgaacccctacatgcccagcgtcatcgagaagatggagaccctccagcgcaagtacgggggcgccctggtgcggaacccgctgtcccgcaacagcacgcacgagatgtactgggtgtccaacgcgaccgggaacatcgtcagctccgtgaacatgatcagccggatgctgatcaaccgcttcaccatgaagcacaagaaggccacctacgagcccgacgtggacctcggctccgggacgcggaacatcggcatcgagagcgagatccccaacctggacatcatcggcaagcgcatcgagaagatcaagcaggagcacgagacctcctggcactacgaccaggaccacccctacaagacctgggcctaccacgggagctacgagaccaagcagacgggctccgccagctccatggtcaacggggtggtgcgcctgctcaccaagccgtgggacgtcgtgcccatggtgacccagatggccatgaccgacacgacccccttcggccagcagcgggtcttcaaggagaaggtggacacccgcacccaggagcccaaggagggcacgaagaagctgatgcggatcaccgcggagtggctgtggaaggagctcgggaagaagaagaccccgcgcatgtgcacccgggaggagttcacgcgcaaggtgcggagcaacgccgccctgggcgccatcttcaccgacgagaacaagtggaagtccgcccgcgaggcggtcgaggacgggcggttctgggagctggtggaccgcgagcggaacctccacctggagggcaagtgcgagacctgcgtctacaacatgatggggaagcgcgagaagaagctgggcgagttcggcaaggccaaggggagccgggccatctggtacatgtggctcggcgcccgcttcctggagttcgaggcgctggggttcctcaacgaggaccactggttctcccggggcaacagcctgtccggggtggagggcgagggcctgcaccgcctcgggtacatcctgcgggacgtgggcaagaaggagggcggcgccatgtacgccgacgacaccgccgggtgggacacgcgcatcaccctggaggacctcaagaacgaggagatggtcaccaaccacatgaagggcgagcacaagaagctggccgaggcgatcttcaagctgacctaccagaacaaggtggtgcgggtccagcgccccacgccccggggcaccgtgatggacatcatcagccgccgcgaccagcgggggagcggccaggtggggacctacggcctcaacaccttcacgaacatggaggcccagctgatccgccagatggagggcgaggggatcttcaagtccatccagcacctgaccgtcaccgaggagatcgccgtgcagaactggctcgcccgggtgggccgcgagcggctgagccgcatggccatctccggggacgactgcgtcgtgaagcccatcgacgaccggttcgcgagcgccctgaccgccctcaacgacatgggcaaggtgcgcaaggacatccagcagtgggagccgtcccgggggtggaacgactggacgcaggtccccttctgcagccaccacttccacgagctggtgatgaaggacggccgcgtgctggtcgtgccctgccggaaccaggacgagctcatcggccgcgcccggatctcccagggggccggctggagcctgaaggagaccgcgtgcctggggaagtcctacgcccagatgtggaccctcatgtacttccaccgccgggacctgcgcctggccgccaacgccatctgcagcgcggtgccctcccactgggtcccgaccagccggaccacgtggtccatccacgccaagcacgagtggatgaccaccgaggacatgctcgccgtgtggaaccgcgtgtggatccaggagaacccctggatggaggacaagacccccgtcgagagctgggaggaggtgccctacctgggcaagcgggaggaccagtggtgcgggtccctgatcggcctcacgagccgcgccacctgggcgaagaacatccagaccgccatcaaccaggtgcgctccctgatcggcaacgaggagtacaccgactacatgccgagcatgaagcggttccgccgggaggaggaggaggccggggtcctgtggtga

SEQ ID NO: 9489 - RNA, 9876 nt, synthetic construct
  misc_feature 1..9876: note = derived and/or modified CDS sequence (opt1) from DENV-2__FJ898465__SS-prME
  source 1..9876: mol_type = other RNA
accgcgggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcgccatcatggcggccatcctggcctacaccatcgggaccacccacttccagaaggccctcatcttcatcctgctgaccgcggtggcccccagcatgaccatgcggtgcatcggcatctccaaccgcgacttcgtggagggcgtcagcgggggctcctgggtggacatcgtgctcgagcacgggagctgcgtcaccaccatggccaagaacaagcccaccctggacttcgagctgatcaagaccgaggccaagcagcccgccaccctccggaagtactgcatcgaggcgaagctgaccaacacgaccaccgagtcccgctgcccgacccagggcgagcccagcctgaacgaggagcaggacaagcggttcatctgcaagcactccatggtggaccgcggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccgccagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccggctccgcatggacaagctgcagctgaaggggatgtcctacagcatgtgcaccggcaagttcaagatcgtcaaggagatcgcggagacccagcacgggaccatcgtgatccgggtgcagtacgagggcgacggctccccctgcaagatccccttcgagatcatggacctcgagaagcgccacgtcctggggcggctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcgcatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccggtccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccgcagcgtcacccggctcgagaacctgatgtggaagcagatcacccccgagctgaaccacatcctctccgagaacgaggtgaagctgaccatcatgacgggcgacatcaaggggatcatgcaggcgggcaagcgcagcctgcggccgcagcccaccgagctcaagtactcctggaagacctggggcaaggccaagatgctgagcaccgagtcccacaaccagacgttcctgatcgacgggcccgagaccgccgagtgcccgaacaccaaccgcgcctggaacagcctcgaggtggaggactacggcttcggggtcttctccaccaacatctggctgaagctgcgggagaagcaggacgtgttctgcgacagcaagctcatgtccgccgcgatcaaggacaaccgcgccgtgcacgccgacatgggctactggatcgagagcgccctgaacgacacgtggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccggccgggctaccacacccagaccgccgggccctggcacctgggcaagctggagatggacttcgacttctgcgaggggaccacggtcgtggtgaccgaggactgcggcaaccgcggccccagcctccggaccaccacggcctccgggaagctgatcaccgagtggtgctgccgcagctgcaccctgcccccgctccggtaccgcggcgaggacgggtgctggtacggcatggagatccggcccctgaaggagaaggaggagaacctggtcaactccctcgtgaccgccgggcacggccagatcgacaacttcagcctgggcgtgctggggatggccctcttcctggaggagatgctgcgcacgcgggtcggcaccaagcacgccatgctcctggtggccgtgtccttcgtcaccctgatcaccgggaacatgagcttccgcgacctcggccgggtgatggtgatggtcggggccacgatgaccgacgacatcggcatgggcgtgacctacctggccctgctcgcggccttcaaggtgcgccccaccttcgccgccgggctgctgctccgcaagctgacgtccaaggagctgatgatggccaccatcggcatcgcgctcctgagccagtccaccatccccgagaccatcctggagctcacggacgccctggccctggggatgatggtcctcaagatcgtgcggaacatggagaactaccagctggccgtgaccatcatggccatcagctgcgtcccgaacgcggtgatcctgctcaacgcctggaaggtgtcctgcaccatcctggccgccgtcagcgtgagccccctgctcctgaccagctcccagcagaaggcggactggatccccctggccctcacgatcaagggcctgaaccccaccgccatcttcctgaccaccctcagccgcacgtccaagaagcggagctggccgctgaacgaggccgtcatggccgtgggcatggtgtccatcctggcgagcagcctcctgaagaacgacatccccatgaccgggcccctggtcgccggcgggctcctgaccgtgtgctacgtgctgaccggccgctccgccgacctcgagctggagcgggccgccgacgtcaagtgggaggaccacgcggagatcagcgggtccagccccatcctgtccatcacgatcagcgaggacggctccatgagcatcaagaacgaggaggaggagcagaccctcaccatcctgatccgcaccggcctgctcgtgatctccggggtgttcccggtcagcatccccatcacggccgccgcctggtacctgtgggaggtgaagaagcagcgggccggcgtgctgtgggacgtccccagcccgccgcccgtggggaaggcggagctcgaggacggcgcctaccgcatcaagcagcgggggatcctgggctacagccagatcggcgccggggtgtacaaggagggcaccttccacaccatgtggcacgtcacccgcggggccgtgctgatgcaccggggcaagcgcatcgagccctcctgggccgacgtgaagaaggacctcatcagctacgggggcggctggaagctggagggggagtggaaggagggcgaggaggtccaggtgctggcgctcgagcccgggaagaacccccgggccgtgcagaccaagcccggcctgttcaagacgaacaccgggaccatcggcgccgtctccctggacttcagccccggcacctccgggagccccatcgtggaccgcaagggcaaggtggtcgggctctacggcaacggcgtggtgacgcggtccggggcctacgtcagcgcgatcgcccagaccgagaagtccatcgaggacaaccccgagatcgaggacgacatcttccgcaagaagcggctgaccatcatggacctgcaccccggcgccgggaagaccaagcgctacctgcccgccatcgtgcgggaggccatcaagcgcggcctccggacgctgatcctggcgccgacccgcgtggtcgccgccgagatggaggaggccctccgcgggctgcccatccggtaccagacccccgccatccgcgcggagcacaccggccgggagatcgtggacctgatgtgccacgccacgttcaccatgcgcctcctgtcccccgtgcgggtcccgaactacaacctgatcatcatggacgaggcccacttcaccgaccccgccagcatcgccgcgcgcggctacatctccacccgggtggagatgggggaggccgccggcatcttcatgacggccacgccgcccgggagccgcgacccgttcccccagtccaacgcgcccatcatggacgaggagcgggagatccccgagcgcagctggaactccggccacgagtgggtgaccgacttcaaggggaagaccgtctggttcgtgccgagcatcaaggccggcaacgacatcgccgcctgcctccggaagaacggcaagaaggtgatccagctgtcccgcaagacgttcgacagcgagtacgtcaagacccgggccaacgactgggacttcgtggtgaccaccgacatctccgagatgggggcgaacttccgcgccgagcgggtcatcgacccccgccggtgcatgaagcccgtgatcctgacggacggcgaggagcgcgtgatcctcgccgggcccatgccggtcacccacagctccgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacccccgagggcatcatcccgagcatgttcgagcccgagcgcgagaaggtggacgccatcgacggggagtaccggctgcgcggcgaggcccggaagaccttcgtggacctgatgcgccgcggggacctccccgtctggctggcctaccgcgtggcggccgagggcatcaactacgccgaccggcgctggtgcttcgacgggatcaagaacaaccagatcctggaggagaacgtggaggtcgagatctggacgaaggagggcgagcggaagaagctcaagccgcgctggctggacgcccggatctactccgaccccctggcgctcaaggagttcaaggagttcgccgccggccgcaagagcctgaccctgaacctcatcaccgagatggggcggctgcccaccttcatgacgcagaaggcccgcgacgccctggacaacctcgcggtgctgcacaccgccgaggccggcgggcgggcctacaaccacgccctgtccgagctccccgagaccctggagaccctgctcctgctgacgctcctggcgaccgtcaccggcggcatcttcctgttcctcatgagcgggaagggcatcgggaagatgaccctgggcatgtgctgcatcatcacggcctccatcctgctctggtacgcccagatccagccgcactggatcgccgccagcatcatcctggagttcttcctgatcgtgctcctgatccccgagcccgagaagcagcgcacgccccaggacaaccagctgacctacgtggtcatcgcgatcctcaccgtggtggccgccaccatggccaacgagatggggttcctggagaagacgaagaaggacctgggcctcggcagcatcaccacccaggagtccgagagcaacatcctggacatcgacctgcggccggcctccgcgtggaccctctacgccgtcgccacgaccttcgtgacccccatgctgcgccacagcatcgagaactccagcgtgaacgtctccctgaccgccatcgcgaaccaggccacggtgctcatggggctgggcaaggggtggcccctgagcaagatggacatcggcgtgcccctcctggccatcgggtgctactcccaggtcaacccgatcaccctgaccgccgccctcctgctgctcgtggcgcactacgccatcatcggccccggcctgcaggccaaggccacccgggaggcccagaagcgcgcggccgccgggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcgcaccacgtgggccctgtgcgaggccctcaccctggcgaccggccccatcagcaccctgtgggaggggaaccccggccggttctggaacacgaccatcgccgtgtccatggccaacatcttccgcggcagctacctcgccggggcgggcctgctgttctccatcatgaagaacaccaccaacacgcggcgcgggaccggcaacatcggcgagaccctcggggagaagtggaagtcccggctgaacgccctgggcaagtccgagttccagatctacaagaagtccgggatccaggaggtggaccgcaccctcgccaaggagggcatcaagcgcggggagacggaccaccacgccgtctcccgcggcagcgccaagctgcggtggttcgtggagcgcaacatggtgaccccggagggcaaggtcgtggacctggggtgcggccgcggcgggtggtcctactactgcggcgggctcaagaacgtgcgcgaggtcaaggggctgaccaagggcgggcccgggcacgaggagcccatccccatgagcacctacggctggaacctggtgcggctccagagcggggtggacgtcttcttcacgccgcccgagaagtgcgacaccctgctgtgcgacatcggcgagtccagccccaaccccaccatcgaggcgggccgcaccctccgggtgctgaacctggtggagaactggctcaacaacaacacgcagttctgcatcaaggtcctgaacccgtacatgccctccgtgatcgagaagatggagaccctgcagcgcaagtacgggggcgccctggtgcggaaccccctcagccgcaactccacccacgagatgtactgggtcagcaacgccaccgggaacatcgtgtccagcgtgaacatgatctcccggatgctgatcaaccgcttcaccatgaagcacaagaaggccacgtacgagccggacgtcgacctgggcagcgggacccgcaacatcggcatcgagtccgagatccccaacctcgacatcatcggcaagcggatcgagaagatcaagcaggagcacgagaccagctggcactacgaccaggaccacccctacaagacctgggcctaccacgggtcctacgagacgaagcagaccggcagcgcgtccagcatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgccgagtggctgtggaaggagctggggaagaagaagacgccccggatgtgcacgcgggaggagttcacccgcaaggtccggtccaacgccgccctcggcgcgatcttcaccgacgagaacaagtggaagtccgcccgcgaggccgtggaggactcccggttctgggagctggtggaccgcgagcggaacctgcacctcgaggggaagtgcgagacctgcgtctacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttcagccgggggaactccctcagcggcgtggagggggagggcctgcaccgcctgggctacatcctccgggacgtctccaagaaggagggcggggccatgtacgccgacgacacggcggggtgggacacccgcatcaccctggaggacctgaagaacgaggagatggtgaccaaccacatgaagggcgagcacaagaagctcgccgaggccatcttcaagctgacgtaccagaacaaggtggtccgggtgcagcgcccgacgccccgggggaccgtgatggacatcatcagccggcgcgaccagcggggctccggccaggtcgggacctacggcctgaacacgttcaccaacatggaggcccagctcatccgccagatggagggggagggcatcttcaagagcatccagcacctgaccgtgaccgaggagatcgccgtgcagaactggctggcgcgggtcggccgcgagcggctctcccgcatggccatcagcggggacgactgcgtggtgaagcccctggacgaccggttcgcctccgccctgacggccctcaacgacatgggcaaggtccgcaaggacatccagcagtgggagcccagccgggggtggaacgactggacccaggtgccgttctgctcccaccacttccacgagctggtgatgaaggacggccgcgtcctggtggtgccctgccggaaccaggacgagctcatcgggcgcgcgcggatcagccagggcgccggctggtccctgaaggagaccgcctgcctgggcaagagctacgcccagatgtggaccctcatgtacttccaccgccgggacctgcgcctggccgcgaacgccatctgctccgccgtccccagccactgggtgcccacgtcccggaccacctggagcatccacgccaagcacgagtggatgaccaccgaggacatgctcgcggtgtggaaccgcgtctggatccaggagaacccgtggatggaggacaagacgcccgtggagagctgggaggaggtgccctacctgggcaagcgcgaggaccagtggtgcgggtccctgatcggcctcaccagccgggccacctgggccaagaacatccagaccgccatcaaccaggtccgctccctgatcgggaacgaggagtacacggactacatgcccagcatgaagcggttccgccgggaggaggaggaggccggcgtgctgtggtga

SEQ ID NO: 9490 - RNA, 9876 nt, synthetic construct
  misc_feature 1..9876: note = derived and/or modified CDS sequence (opt1) from DENV-2__FJ898466__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagcgggcccacgaggagggcatctgcgggatccgcagcgtgacccggctggagaacctcatgtggaagcagatcacgcccgagctgaaccacatcctgtccgagaacgaggtgaagctcaccatcatgaccggcgacaccaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtcgaggactacggcttcggggtgttcaccaccaacatctggctcaagctgcgggagaagcaggacatcttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccggccgggctaccacacccagaccgcggggccctggcacctcggcaagctggagatggacttcgacttctgcgaggggaccacggtcgtggtgaccgaggactgcggcaaccgcggccccagcctgcggaccaccacggccagcgggaagctcatcaccgagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggccctgttcctcgaggagatgctgcgcacgcgggtcggcaccaagcacgcgatcctgctcgtggccgtgagcttcgtcaccctgatcaccgggaacatgtccttccgcgacctgggccgcgtgatggtgatggtcggggccacgatgaccgacgacatcggcatgggcgtgacctacctcgccctgctggccgcgttcaaggtgcggcccaccttcgccgccgggctcctgctgcgcaagctcacgagcaaggagctgatgatggccaccatcggcatcgccctgctctcccagagcaccatccccgagaccatcctggagctgacggacgcgctcgccctggggatgatggccctgaagatcgtccggaacatggagaagtaccagctcgccgtgaccatcatggccatctcctgcgtgccgaacgcggtcatcctgcagaacgcctggaaggtgagctgcaccatcctggccgccgtgtccgtcagccccctcctgctgacctccagccagcagaaggcggactggatccccctcgccctgacgatcaagggcctgaaccccaccgccatcttcctcaccaccctgtcccgcacgagcaagaagcggtcctggccgctgaacgaggccatcatggccgtgggcatggtcagcatcctcgcgtccagcctgctgaagaacgacatccccatgaccgggcccctcgtggccggcgggctgctgaccgtgtgctacgtcctcaccggccgcagcgccgacctggagctggagcgggccgccgacgtgaagtgggaggaccaggcggagatctccgggagctcccccatcctcagcatcacgatctccgaggacggcagcatgtccatcaagaacgaggaggaggagcagaccctgaccatcctgatccgcaccggcctcctggtgatcagcggggtcttcccggtgtccatccccatcaccgccgccgcctggtacctgtgggaggtgaagaagcagcgggccggcgtcctctgggacgtgcccagcccgccgcccgtggggaaggcggagctggaggacggcgcctaccgcatcaagcagcgggggatcctgggctactcccagatcggcgccggggtctacaaggagggcacgttccacaccatgtggcacgtgacccgcggggccgtgctcatgcaccggggcaagcgcatcgagcccagctgggccgacgtcaagaaggacctgatctcctacgggggcggctggaagctggagggggagtggaaggagggcgaggaggtccaggtgctcgcgctggagcccgggaagaacccccgggccgtccagaccaagcccggcatcttccgcacgaacaccgggaccatcggcgccgtgagcctggacttctcccccggcaccagcgggtcccccatcgtggaccggaagggcaaggtcgtggggctctacggcaacggcgtggtcacgcgcagcggggcctacgtgtccgcgatcgcccagaccgagaagtccatcgaggacaaccccgagatcgaggacgacatcttccggaagaagcgcctgaccatcatggacctgcaccccggcgccgggaagaccaagcggtacctccccgccatcgtgcgcgaggccatcaagcgcggcctgcggacgctgatcctggcgccgacccgcgtcgtggccgccgagatggaggaggccctccgggggctgcccatccgctaccagacccccgccatcaaggcggagcacaccggccgggagatcgtggacctgatgtgccacgccacgttcaccatgcgcctcctgagccccgtccgggtgccgaactacaacctgatcatcatggacgaggcccacttcaccgaccccgcctccatcgccgcgcgcggctacatcagcacccgggtggagatgggggaggccgccggcatcttcatgacggccacgccgcccgggtcccgcgacccgttcccccagagcaacgcgcccatcatggacgaggagcgggagatccccgagcgctcctggaacagcggccacgagtgggtcaccgacttcaaggggaagaccgtgtggttcgtgccgtccatcaaggccggcaacgacatcgccgcctgcctccggaagaacggcaagaaggtcatccagctgagccgcaagacgttcgactccgagtacgtgaagacccgggccaacgactgggacttcgtggtcaccaccgacatcagcgagatgggggcgaacttcaaggccgagcgcgtgatcgacccccggcgctgcatgaagcccgtgatcctgacggacggcgaggagcgggtcatcctcgccgggcccatgccggtgacccactccagcgccgcccagcgccgcggccggatcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgggagaaggtggacgccatcgacggggagtaccgcctgcggggcgaggcccgcaagaccttcgtcgacctgatgcggcgcggggacctccccgtgtggctggcctacaaggtggcggccgagggcatcaactacgccgaccggaagtggtgcttcgacgggatcaagaacaaccagatcctggaggagaacgtcgaggtggagatctggacgaaggagggcgagcgcaagaagctcaagccgcggtggctggacgcccgcatctacagcgaccccctggcgctcaaggagttcaaggagttcgccgccggccggaagtccctgaccctgaacctcatcaccgagatggggcgcctgcccaccttcatgacgcagaaggcccggaacgccctggacaacctcgcggtgctgcacaccgccgaggccggcgggcgcgcctacaaccacgccctgagcgagctccccgagaccctggagaccctgctcctgctgacgctcctggcgaccgtcaccggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcaccgtggtcgccgccaccatggccaacgagatggggttcctggagaagacgaagaaggacctgggcctcggcagcatcaccacccaggagagcgagtccaacatcctggacatcgacctgcgcccggccagcgcgtggaccctctacgccgtggccacgaccttcatcacccccatgctgcggcactccatcgagaacagctccgtgaacgtcagcctgaccgccatcgcgaaccaggccacggtgctcatggggctgggcaaggggtggcccctgtccaagatggacatcggcgtgcccctcctggccatcgggtgctacagccaggtcaacccgatcaccctgaccgccgccctcctgctgctcgtggcgcactacgccatcatcggccccggcctgcaggccaaggccacccgcgaggcccagaagcgggcggccgccgggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcgcaccacgtgggccctgtgcgaggccctcaccctggcgaccggccccatctccaccctgtgggaggggaaccccggccgcttctggaacacgaccatcgccgtgagcatggccaacatcttccggggctcctacctcgccggggcgggcctgctgttcagcatcatgaagaacaccaccaacacgcgccgggggaccggcaacatcggcgagaccctcggggagaagtggaagtcccgcctgaacgccctgggcaagagcgagttccagatctacaagaagtccgggatccaggaggtggaccggaccctcgccaaggagggcatcaagcgcggggagacggaccaccacgccgtcagccggggctccgccaagctgcgctggttcgtggagcggaacatggtgaccccggagggcaaggtcgtggacctggggtgcggccgcgggggctggagctactactgcgggggcctcaagaacgtgcgggaggtcaagggcctgaccaagggcgggcccgggcacgaggagcccatccccatgtccacctacggctggaacctggtgcgcctccagagcggggtggacgtcttcttcacgccgcccgagaagtgcgacaccctgctgtgcgacatcggcgagagctcccccaaccccaccatcgaggcgggccggaccctccgcgtgctgaacctggtggagaactggctcaacaacaacacccagttctgcatcaaggtcctgaacccgtacatgcccagcgtgatcgagaagatggagacgctgcagcggaagtacgggggcgccctcgtgcgcaaccccctgtcccggaacagcacccacgagatgtactgggtctccaacgccaccgggaacatcgtgagctccgtgaacatgatcagccgcatgctgatcaaccggttcaccatgaagcacaagaaggccacgtacgagccggacgtcgacctgggctccgggacccgcaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgcgagctccatggtgaacggggtggtccggctgctgaccaagccctgggacgtggtgccgatggtcacccagatggccatgacggacaccacccccttcggccagcagcgcgtgttcaaggagaaggtggacacccggacgcaggagcccaaggagggcaccaagaagctcatgaagatcaccgccgagtggctgtggaaggagctggggaagcgcaagacgccccggatgtgcacgcgcgaggagttcaccaagaaggtccggagcaacgccgccctcggcgcgatcttcaccgacgagaacaagtggaagtccgcccgcgaggccgtggaggacgggcggttctgggagctggtggaccgcgagcggaacctgcacctcgagggcaagtgcgagacctgcgtctacaacatgatggggaagcgcgagaagaagctgggcgagttcggcaaggccaaggggagccgggcgatctggtacatgtggctgggcgcccgcttcctcgagttcgaggccctggggttcctgaacgaggaccactggttctcccggggcaacagcctcagcggggtggagggcgagggcctgcaccgcctggggtacatcctccgggacgtgggcaagaaggagggcggggccatgtacgccgacgacacggcggggtgggacacccgcatcaccctggaggacctgaagaacgaggagatggtcaccaaccacatgaagggcgagcacaagaagctcgccgaggccatcttcaagctgacgtaccagaacaaggtggtccgggtgcagcgcccgacgccccggggcaccgtgatggacatcatctcccgccgcgaccagcgggggagcggccaggtcgggacctacggcctgaacacgttcaccaacatggaggcccagctcatccgccagatggagggcgaggggatcttcaagtccatccagcacctgaccgccaccgaggagatcgcggtgcagaactggctggcccgggtgggccgcgagcggctcagccgcatggccatctccggggacgactgcgtcgtgaagcccatcgacgaccggttcgccagcgccctgacggcgctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggtcccaggacgagctgatcggccgcgcccggatcagccagggggccggctggtccctcaaggagaccgcctgcctgggcaagagctacgcccagatgtggaccctgatgtacttccaccgccgggacctccgcctggcggccaacgccatctgctccgccgtgcccagccactgggtccccacctcccggacgacctggagcatccacgcgaagcacgagtggatgaccaccgaggacatgctggccgtgtggaaccgcgtgtggatccaggagaacccgtggatggaggacaagacgcccgtcgagtcctgggaggaggtgccctacctcggcaagcgggaggaccagtggtgcgggagcctgatcggcctgaccagccgcgccacctgggccaagaacatccagaccgccatcaaccaggtgcgctccctcatcggcaacgaggagtacacggactacatgcccagcatgaagcggttccgccgggaggaggaggaggcgggggtcctgtggtga

SEQ ID NO: 9491 - RNA, 9876 nt, synthetic construct
  misc_feature 1..9876: note = derived and/or modified CDS sequence (opt1) from DENV-2__FJ898467__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtcctgaagatcgtgcgcaacatggagaagtaccagctcgccgtgaccatcatggccatctcctgcgtcccgaacgccgtgatcctgcggaacgcctggaaggtgagctgcaccatcctggcggccgtctccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtcggcatggtgagcatcctcgcctccagcctgctgaagaacgacatccccatgaccgggcccctcgtggccggcgggctgctgaccgtctgctacgtgctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgcgggggtgtacaaggagggcacgttccacaccatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgcggtgagcctggacttctcccccggcaccagcgggtcccccatcgtcgaccgcaagggcaaggtggtggggctctacggcaacggcgtcgtgacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcacgctgatcctggccccgacccgggtggtggccgcggagatggaggaggccctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcgcacttcaccgaccccgcctccatcgccgcccggggctacatcagcacccgcgtcgagatgggggaggccgcgggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgcggggcccatgccggtgacccactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgcgatcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtggagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtcctgcacaccgccgaggcgggcgggaaggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcgcagatccagccgcactggatcgccgcctccatcatcctggagttcttcctgatcgtgctcctgatccccgagcccgagaagcagcggacgccccaggacaaccagctgacctacgtggtcatcgccatcctcaccgtggtggccgcgaccatggccaacgagatggggttcctggagaagacgaagaaggacctgggcctcggcagcatcaccacccaggagagcgagtccaacatcctggacatcgacctgcgcccggccagcgcctggaccctctacgccgtcgcgacgaccttcgtgacccccatgctgcggcactccatcgagaacagctccgtgaacgtcagcctgaccgccatcgccaaccaggccacggtgctcatggggctgggcaaggggtggcccctgtccaagatggacatcggcgtgcccctcctggcgatcgggtgctacagccaggtcaacccgatcaccctgaccgccgccctcctgctgctcgtggcccactacgccatcatcggccccggcctgcaggcgaaggccacccgcgaggcccagaagcgggccgccgcggggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcgcaccacgtgggccctgtgcgaggccctcaccctggccaccggccccatctccaccctgtgggaggggaaccccggccggttctggaacacgaccatcgccgtgagcatggcgaacatcttccgcggctcctacctcgccggggccggcctgctgttcagcatcatgaagaacaccaccaacacgcgccgggggaccggcaacatcggcgagaccctcggggagaagtggaagtcccgcctgaacgccctgggcaagagcgagttccagatctacaagaagtccgggatccaggaggtggaccggaccctcgcgaaggagggcatcaagcgcggggagacggaccaccacgccgtcagccggggctccgccaagctgcgctggttcgtggagcggaacatggtgaccccggagggcaaggtcgtggacctggggtgcggccgcgggggctggagctactactgcgggggcctcaagaacgtgcgggaggtcaagggcctgaccaagggcgggcccgggcacgaggagcccatccccatgtccacctacggctggaacctggtgcgcctccagagcggggtggacgtcttcttcacgccgcccgagaagtgcgacaccctgctgtgcgacatcggcgagagctcccccaaccccaccatcgaggccggccggaccctccgcgtgctgaacctggtggagaactggctcaacaacaacacccagttctgcatcaaggtcctgaacccgtacatgcccagcgtgatcgagaagatggagacgctgcagcggaagtacgggggcgccctcgtgcgcaaccccctgtcccggaacagcacccacgagatgtactgggtctccaacgcgaccgggaacatcgtgagctccgtgaacatgatcagccgcatgctgatcaaccggttcaccatgaagcacaagaaggccacgtacgagccggacgtcgacctgggctccgggacccgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggccatgacggacaccacccccttcggccagcagcgcgtgttcaaggagaaggtggacacccggacgcaggagcccaaggagggcaccaagaagctcatgcgcatcaccgcggagtggctgtggaaggagctggggaagaagaagacgccccggatgtgcacgcgcgaggagttcacccggaaggtccgcagcaacgccgccctcggcgccatcttcaccgacgagaacaagtggaagtccgcccgggaggcggtggaggacgggcgcttctgggagctggtggacaaggagcggaacctgcacctcgagggcaagtgcgagacctgcgtctacaacatgatggggaagcgcgagaagaagctgggcgagttcggcaaggccaaggggagccgggccatctggtacatgtggctgggcgcccgcttcctcgagttcgaggcgctggggttcctgaacgaggaccactggttctcccggggcaacagcctcagcggggtggagggcgagggcctgcaccgcctggggtacatcctccgggacgtcggcaagaaggagggcggcgccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagaacaaggtggtccgggtgcagcgcccgacgccccggggcaccgtgatggacatcatctcccgccgggaccagcgcgggagcggccaggtcgggacctacggcctgaacacgttcaccaacatggaggcccagctcatccgccagatggagggcgaggggatcttcaagtccatccagcacctgaccgccaccgaggagatcgccgtgcagaactggctggcccgggtgggccgcgagcggctcagccgcatggcgatctccggggacgactgcgtcgtgaagcccatcgacgaccggttcgccagcgccctgacggccctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcggccgcgcccggatctcccagggggcgggctggagcctcaaggagaccgcctgcctggggaagtcctacgcccagatgtggaccctgatgtacttccaccgccgggacctccgcctggccgccaacgcgatctgcagcgccgtgccctcccactgggtccccaccagccggacgacctggtccatccacgccaagcacgagtggatgaccaccgaggacatgctggccgtgtggaaccgcgtgtggatccaggagaacccgtggatggaggacaagacgcccgtcgagagctgggaggaggtgccctacctcggcaagcgggaggaccagtggtgcgggtccctgatcggcctgaccagccgcgcgacctgggccaagaacatccagaccgccatcaaccaggtgcggagcctcatcggcaacgaggagtacacggactacatgccctccatgaagcgcttccgccgggaggaggaggaggccggggtcctgtggtga

SEQ ID NO: 9492 - RNA, 9876 nt, synthetic construct
  misc_feature 1..9876: note = derived and/or modified CDS sequence (opt1) from DENV-2__GQ868595__SS-prME
  source 1..9876: mol_type = other RNA
accgcgggcgtgatcatcatgctgatccccaccgccatggcgttccacctcaccacccggaacggggagccccacatgatcgtcagccggcaggagaagggcaagagcctgctgttcaagaccgaggacggggtgaacatgtgcaccctcatggccatcgacctgggcgagctgtgcgaggacaccatcacctacaagtgccccctcctgcgccagaacgagcccgaggacatcgactgctggtgcaacagcaccagcacctgggtgacctacgggacctgcaccaccaccggcgagcaccggcgcgagaagcggagcgtcgccctggtgccccacgtgggcatggggctcgagacccgcaccgagacctggatgagcagcgagggcgcctggaagcacgtccagcggatcgagacctggatcctgcgccacccggggttcgccatcatggcggccatcctggcctacaccatcggcaccacccacttccagcgggccctcatcttcatcctgctgacggcggtggccccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggcgaagctgaccaacacgaccaccgagagccggtgcccgacccagggggagccctccctgaacgaggagcaggacaagcgcttcatctgcaagcacagcatggtggaccggggctggggcaacgggtgcggcctcttcgggaagggcgggatcgtgacgtgcgccatgttcacgtgcaagaagaacatggagggcaaggtcgtgctgcccgagaacctggagtacaccatcgtgatcacgccccactccggcgaggagcacgccgtcgggaacgacacgggcaagcacgggaaggagatcaagatcaccccgcagagctccatcaccgaggccgagctcaccggctacgggaccgtgacgatggagtgcagcccccgcaccggcctggacttcaacgagatggtgctgctccagatggaggagaaggcctggctggtccaccggcagtggttcctggacctccccctgccctggctgccgggcgcggacacccaggggtccaactggatccagaaggagaccctcgtgacgttcaagaacccccacgccaagaagcaggacgtggtcgtgctgggcagccaggagggggccatgcacaccgccctgaccggcgccaccgagatccagatgagctccgggaacctcctgttcacgggccacctgaagtgccgcctccggatggacaagctgcagctgaagggcatgagctactccatgtgcaccgggaagttcaagatcgtcaaggagatcgcggagacccagcacggcaccatcgtgatccgcgtgcagtacgagggggacggcagcccctgcaagatccccttcgagatcatggacctcgagaagcggcacgtcctgggccgcctgatcacggtgaacccgatcgtgaccgagaaggactcccccgtcaacatcgaggccgagccgcccttcggggacagctacatcatcatcggcgtggagccggggcagctcaagctgaactggttcaagaagggctccagcatcgggcagatgttcgagaccaccatgcgcggcgccaagcggatggccatcctgggcgacacggcctgggacttcgggtccctcggcggggtgttcaccagcatcggcaaggcgctgcaccaggtcttcggggccatctacggcgccgccttctccggcgtgagctggaccatgaagatcctgatcggggtgatcatcacctggatcggcatgaactcccgcagcacgtccctgagcgtctccctcgtgctggtgggggtcgtgaccctgtacctcggcgcgatggtgcaggccgacagcgggtgcgtcgtgtcctggaagaacaaggagctgaagtgcggcagcggcatcttcatcaccgacaacgtgcacacctggacggagcagtacaagttccagcccgagagcccctccaagctggccagcgccatccagaaggcccacgaggaggggatctgcggcatccggtccgtcacccgcctcgagaacctgatgtggaagcagatcacccccgagctgaaccacatcctcagcgagaacgaggtgaagctgaccatcatgacgggggacatcaagggcatcatgcaggcggggaagcggtccctgcgcccgcagcccaccgagctcaagtacagctggaagacctggggcaaggccaagatgctgtccaccgagagccacaaccagacgttcctgatcgacggccccgagaccgccgagtgcccgaacaccaaccgggcctggaactccctcgaggtggaggactacgggttcggcgtcttcaccacgaacatctggctgaagctgcgcgagaagcaggacgtgttctgcgacagcaagctcatgtccgccgcgatcaaggacaaccgggccgtgcacgccgacatggggtactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcgggccccgtgagccagcacaactaccgcccggggtaccacacccagaccgccggcccctggcacctggggaagctggagatggacttcgacttctgcgagggcacgaccgtcgtggtgaccgaggactgcgggaaccggggccccagcctccgcaccacgaccgcctccggcaagctgatcaccgagtggtgctgccggagctgcaccctgcccccgctccgctaccgcggggaggacggctgctggtacgggatggagatccgccccctgaaggagaaggaggagaacctggtcaactccctcgtgacggccggccacgggcagatcgacaacttcagcctgggcgtgctgggcatggccctcttcctggaggagatgctgcggacccgcgtcgggaccaagcacgccatcctcctggtggccgtgtccttcgtcaccctgatcacgggcaacatgagcttccgggacctcgggcgcgtgatggtgatggtcggcgccaccatgaccgacgacatcgggatgggcgtgacctacctggccctgctcgcggccttcaaggtgcgccccacgttcgccgccggcctgctgctccggaagctgacctccaaggagctgatgatggccaccatcgggatcgcgctcctgagccagtccaccatccccgagacgatcctggagctcaccgacgccctggccctgggcatgatggtcctcaagatcgtgcgcaacatggagaagtaccagctggccgtgaccatcatggccatcagctgcgtcccgaacgcggtgatcctgctcaacgcctggaaggtgtcctgcaccatcctggccgccgtcagcgtgagccccctgctcctgacgagctcccagcagaaggcggactggatccccctggccctcaccatcaaggggctgaaccccaccgccatcttcctgaccacgctcagccggacctccaagaagcgcagctggccgctgaacgaggccgtcatggccgtgggcatggtgtccatcctggcgagcagcctcctgaagaacgacatccccatgaccggccccctggtcgccgggggcctcctgaccgtgtgctacgtgctgacggggcggtccgccgacctcgagctggagcgcgccgccgacgtcaagtgggaggaccaggcggagatcagcggctccagccccatcctgtccatcaccatcagcgaggacgggtccatgagcatcaagaacgaggaggaggagcagaccctcaccatcctgatccggacgggcctgctcgtgatctccggcgtgttcccggtcagcatccccatcaccgccgccgcctggtacctgtgggaggtgaagaagcagcgcgccggggtgctgtgggacgtccccagcccgccgcccgtgggcaaggcggagctcgaggacggggcctaccggatcaagcagcgcggcatcctggggtacagccagatcggcgccggcgtgtacaaggaggggaccttccacaccatgtggcacgtcacccggggcgccgtgctgatgcaccgcgggaagcggatcgagccctcctgggccgacgtgaagaaggacctcatcagctacggcgggggctggaagctggagggcgagtggaaggagggggaggaggtccaggtgctggcgctcgagcccggcaagaacccccgcgccgtgcagacgaagcccgggctgttcaagaccaacaccggcaccatcggggccgtctccctggacttcagccccggcacgtccggcagccccatcgtggaccggaaggggaaggtggtcggcctctacgggaacggcgtggtgacccgctccggcgcctacgtcagcgcgatcgcccagaccgagaagtccatcgaggacaaccccgagatcgaggacgacatcttccggaagaagcgcctgaccatcatggacctgcaccccggggccggcaagacgaagcggtacctgcccgccatcgtgcgcgaggccatcaagcgggggctccgcaccctgatcctggcgccgacccgcgtggtcgccgccgagatggaggaggccctccggggcctgcccatccgctaccagacccccgccatccgggcggagcacacggggcgcgagatcgtggacctgatgtgccacgccaccttcaccatgcggctcctgtcccccgtgcgcgtcccgaactacaacctgatcatcatggacgaggcccacttcaccgaccccgccagcatcgccgcgcggggctacatctccacgcgcgtggagatgggcgaggccgccgggatcttcatgaccgccacgccgcccggcagccgggacccgttcccccagtccaacgcgcccatcatggacgaggagcgcgagatccccgagcggagctggaactccgggcacgagtgggtgaccgacttcaagggcaagacggtctggttcgtgccgagcatcaaggccgggaacgacatcgccgcctgcctccgcaagaacggcaagaaggtgatccagctgtcccggaagaccttcgacagcgagtacgtcaagacccgcgccaacgactgggacttcgtggtgaccacggacatctccgagatgggcgcgaacttccgggccgagcgcgtcatcgacccccggcgctgcatgaagcccgtgatcctgaccgacggggaggagcgggtgatcctcgccggccccatgccggtcacccacagctccgccgcccagcgccgcgggcggatcggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtggacgccatcgacggcgagtaccgcctgcgcggggaggcccgcaagacgttcgtggacctgatgcggcgcggcgacctccccgtctggctggcctaccgggtggcggccgaggggatcaactacgccgaccgccggtggtgcttcgacggcatcaagaacaaccagatcctggaggagaacgtggaggtcgagatctggaccaaggagggggagcgcaagaagctcaagccgcggtggctggacgcccgcatctactccgaccccctggcgctcaaggagttcaaggagttcgccgccggccggaagtccctgaccctgaacctcatcaccgagatgggccgcctgcccacgttcatgacccagaaggcccgggacgccctggacaacctcgcggtgctgcacaccgccgaggccgggggccgcgcctacaaccacgccctgtccgagctccccgagaccctggagacgctgctcctgctgaccctcctggcgaccgtcaccgggggcatcttcctgttcctcatgagcggcaaggggatcggcaagatgacgctggggatgtgctgcatcatcaccgcctccatcctgctctggtacgcccagatccagccgcactggatcgccgccagcatcatcctggagttcttcctgatcgtgctcctgatccccgagcccgagaagcagcggacgccccaggacaaccagctgacctacgtggtcatcgcgatcctcaccgtggtggccgccacgatggccaacgagatgggcttcctggagaagaccaagaaggacctggggctcggcagcatcaccacccaggagtccgagagcaacatcctggacatcgacctgcgcccggcctccgcgtggacgctctacgccgtcgccaccaccttcgtgacccccatgctgcggcacagcatcgagaactccagcgtgaacgtctccctgacggccatcgcgaaccaggccaccgtgctcatgggcctggggaagggctggcccctgagcaagatggacatcggggtgcccctcctggccatcggctgctactcccaggtcaacccgatcaccctgaccgccgccctcctgctgctcgtggcgcactacgccatcatcgggcccggcctgcaggccaaggccacgcgcgaggcccagaagcgcgcggccgccggcatcatgaagaaccccaccgtggacgggatcaccgtcatcgacctggagcccatcccgtacgaccccaagttcgagaagcagctcggccaggtgatgctgctgatcctctgcgtgacccaggtcctgatgatgcggacgacctgggccctgtgcgaggccctcaccctggcgaccgggcccatcagcacgctgtgggagggcaaccccgggcgcttctggaacaccaccatcgccgtgtccatggccaacatcttccggggcagctacctcgccggcgcggggctgctgttctccatcatgaagaacaccacgaacacccgccggggcaccgggaacatcggcgagaccctcggcgagaagtggaagtcccgcctgaacgccctggggaagtccgagttccagatctacaagaagtccggcatccaggaggtggaccggacgctcgccaaggaggggatcaagcgcggcgagaccgaccaccacgccgtctcccgggggagcgccaagctgcgctggttcgtggagcggaacatggtgaccccggagggcaaggtcgtggacctgggctgcgggcgcggcgggtggtcctactactgcggcgggctcaagaacgtgcgggaggtcaagggcctgaccaagggcgggcccggccacgaggagcccatccccatgagcacgtacgggtggaacctggtgcgcctccagagcggcgtggacgtcttcttcaccccgcccgagaagtgcgacaccctgctgtgcgacatcggggagtccagccccaaccccaccatcgaggcgggccggacgctccgcgtgctgaacctggtggagaactggctcaacaacaacacccagttctgcatcaaggtcctgaacccgtacatgccctccgtgatcgagaagatggagaccctgcagcggaagtacggcggggccctggtgcgcaaccccctcagccggaactccacccacgagatgtactgggtcagcaacgccaccggcaacatcgtgtccagcgtgaacatgatctcccgcatgctgatcaaccgcttcacgatgaagcacaagaaggccacctacgagccggacgtcgacctggggagcggcacccggaacatcgggatcgagtccgagatccccaacctcgacatcatcggcaagcgcatcgagaagatcaagcaggagcacgagaccagctggcactacgaccaggaccacccctacaagacgtgggcctaccacggctcctacgagaccaagcagaccgggagcgcgtccagcatggtgaacggcgtggtccggctgctgaccaagccctgggacgtggtgccgatggtcacgcagatggccatgaccgacaccacccccttcgggcagcagcgcgtgttcaaggagaaggtggacacgcggacccaggagcccaaggagggcaccaagaagctcatgcgcatcaccgccgagtggctgtggaaggagctgggcaagaagaagacgccccggatgtgcacccgcgaggagttcacccggaaggtccgctccaacgccgccctcggggcgatcttcaccgacgagaacaagtggaagtccgcccgggaggccgtggaggactcccgcttctgggagctggtggaccgggagcgcaacctgcacctcgagggcaagtgcgagacgtgcgtctacaacatgatggggaagcgggagaagaagctgggcgagttcgggaaggccaagggcagccgcgcgatctggtacatgtggctgggcgcccggttcctcgagttcgaggccctggggttcctgaacgaggaccactggttcagccgcggcaactccctcagcggggtggagggcgaggggctgcaccggctgggctacatcctccgcgacgtctccaagaaggagggcggggccatgtacgccgacgacaccgcgggctgggacacccggatcaccctggaggacctgaagaacgaggagatggtgacgaaccacatgcgcggggagcacaagaagctcgccgaggccatcttcaagctgacctaccagaacaaggtggtccgcgtgcagcggccgacgccccggggcaccgtgatggacatcatcagccggcgcgaccagcgggggtccggccaggtcggcacgtacgggctgaacaccttcaccaacatggaggcccagctcatccgccagatggagggcgaggggatcttcaagagcatcaagcacctgaccgtgacggaggagatcgccgtgcagaactggctggcgcgggtcggccgcgagcggctctcccgcatggccatcagcggcgacgactgcgtggtgaagcccctggacgaccggttcgcctccgccctgaccgccctcaacgacatggggaaggtccgcaaggacatccagcagtgggagcccagccggggctggaacgactggacccaggtgccgttctgctcccaccacttccacgagctggtgatgaaggacgggcgcgtcctggtggtgccctgccggaaccaggacgagctcatcggccgcgcgcggatcagccagggggccggctggtccctgaaggagaccgcctgcctgggcaagagctacgcccagatgtggacgctcatgtacttccaccgccgggacctgcgcctggccgcgaacgccatctgctccgccgtccccagccactgggtgcccacctcccgcaccacctggagcatccacgccaagcacgagtggatgaccacggaggacatgctcgcggtgtggaaccgggtctggatccaggagaacccgtggatggaggacaagacccccgtggagagctgggaggaggtgccctacctggggaagcgcgaggaccagtggtgcggctccctgatcgggctcaccagccgggccacctgggccaagaacatccagacggccatcaaccaggtccgctccctgatcggcaacgaggagtacaccgactacatgcccagcatgaagcggttccgccgggaggaggaggaggccggggtgctgtggtga

SEQ ID NO: 9493 - RNA, 9876 nt, synthetic construct
  misc_feature 1..9876: note = derived and/or modified CDS sequence (opt1) from DENV-2__GQ868540__SS-prME
  source 1..9876: mol_type = other RNA
accgccggggtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctggtggacgggcccgagaccgccgagtgcccgaacaccaaccgggcctggaacagcctcgaggtcgaggactacggcttcggggtgttcaccacgaacatctggctgaagctgcgcgagaagcaggacgtgttctgcgactccaagctcatgagcgccgcgatcaaggacaaccgggccgtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgcggggcccgtctcccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtgacggccgggcacggccagatcgacaacttctccctgggcgtcctggggatggccctcttcctggaggagatgctgcggacccgcgtgggcaccaagcacgccatcctcctggtggccgtcagcttcgtgaccctgatcacggggaacatgtccttccgggacctcggccgcgtgatggtcatggtgggggccaccatgaccgacgacatcggcatgggcgtgacctacctggccctgctcgcggccttcaaggtccgccccacgttcgccgccgggctgctgctccggaagctgaccagcaaggagctgatgatggccaccatcggcatcgcgctcctgtcccagagcaccatccccgagacgatcctggagctcaccgacgccctggccctggggatgatggtgctcaagatcgtgcgcaacatggagaagtaccagctggccgtcaccatcatggccatctcctgcgtgccgaacgcggtgatcctgctcaacgcctggaaggtcagctgcaccatcctggccgccgtgtccgtcagccccctgctcctgacgtccagccagcagaaggcggactggatccccctggccctcaccatcaagggcctgaaccccaccgccatcttcctgaccacgctctcccggaccagcaagaagcgctcctggccgctgaacgaggccgtgatggccgtgggcatggtcagcatcctggcgtccagcctcctgaagaacgacatccccatgaccgggcccctggtggccggcgggctcctgaccgtgtgctacgtcctgacgggccggagcgccgacctcgagctggagcgcgccgccgacgtgaagtgggaggaccaggcggagatctccgggagctcccccatcctgagcatcaccatctccgaggacggcagcatgtccatcaagaacgaggaggaggagcagaccctcaccatcctgatccggacgggcctgctcgtgatcagcggggtcttcccggtgtccatccccatcaccgccgccgcctggtacctgtgggaggtgaagaagcagcgcgccggcgtcctgtgggacgtgcccagcccgccgcccgtggggaaggcggagctcgaggacggcgcctaccggatcaagcagcgcgggatcctgggctactcccagatcggcgccggggtctacaaggagggcaccttccacaccatgtggcacgtgacccgcggggcggtgctgatgcaccgcggcaagcggatcgagcccagctgggccgacgtcaagaaggacctcatctcctacgggggcggctggaagctggagggggagtggaaggagggcgaggaggtccaggtgctggcgctcgagcccgggaagaacccccgcgccgtccagacgaagcccggcctgttcaagaccaacaccgggaccatcggcgccgtgagcctggacttctcccccggcacgagcgggtcccccatcgtggaccggaagggcaaggtcgtggggctctacggcaacggcgtggtcacccgcagcggggcctacgtgtccgcgatcgcccagaccgagaagtccatcgaggacaaccccgagatcgaggacgacatcttccggaagaagcgcctgaccatcatggacctgcaccccggcgccgggaagacgaagcggtacctgcccgccatcgtgcgcgaggccatcaagcggggcctccgcaccctgatcctggcgccgacccgcgtcgtggccgccgagatggaggaggccctccgggggctgcccatccgctaccagacccccgccatccgggcggagcacacgggccgcgagatcgtggacctgatgtgccacgccaccttcaccatgcggctcctgagccccgtccgcgtgccgaactacaacctgatcatcatggacgaggcccacttcaccgaccccgcctccatcgccgcgcggggctacatcagcacgcgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtcaccgacttcaaggggaagacggtgtggttcgtgccgtccatcaaggccggcaacgacatcgccgcctgcctccgcaagaacggcaagaaggtcatccagctgagccggaagaccttcgactccgagtacgtgaagacccgcgccaacgactgggacttcgtggtcaccacggacatcagcgagatgggggcgaacttccgggccgagcgcgtgatcgacccccggcgctgcatgaagcccgtgatcctgaccgacggcgaggagcgggtcatcctcgccgggcccatgccggtgacccactccagcgccgcccagcgccgcggccggatcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgggagaaggtggacgccatcgacggggagtaccgcctgcggggcgaggcccgcaagacgttcgtcgacctgatgcggcgcggggacctccccgtgtggctggcctaccgggtggcggccgagggcatcaactacgccgaccgccggtggtgcttcgacgggatcaagaacaaccagatcctggaggagaacatggaggtcgagatctggaccaaggagggcgagcgcaagaagctcaagccgcggtggctggacgcccgcatctacagcgaccccctggcgctcaaggagttcaaggagttcgccgccggccggaagtccctgaccctgaacctcatcaccgagatggggcgcctgcccacgttcatgacccagaaggcccgggacgccctggacaacctcgcggtgctgcacaccgccgaggccggcgggcgcgcctacaaccacgccctgagcgagctccccgagaccctggagacgctgctcctgctgaccctcctggcgaccgtcaccggcggcatcttcctgttcctcatgtccgggaagggcatcgggaagatgacgctgggcatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcaccgtggtggccgccacgatggccaacgagatggggttcctggagaagaccaagaaggacctgggcctcggcagcatcaccacccaggagagcgagtccaacatcctggacatcgacctgcgcccggccagcgcgtggacgctctacgccgtcgccaccaccttcgtgacccccatgctgcggcactccatcgagaacagctccgtgaacgtcagcctgacggccatcgcgaaccaggccaccgtgctcatggggctgggcaaggggtggcccctgtccaagatggacatcggcgtgcccctcctggccatcgggtgctacagccaggtcaacccgatcaccctgaccgccgccctcctgctgctcgtggcgcactacgccatcatcggccccggcctgcaggccaaggccacgcgcgaggcccagaagcgcgcggccgccgggatcatgaagaaccccaccgtggacggcatcaccgtcatcgacctggagcccatcccgtacgaccccaagttcgagaagcagctcggccaggtgatgctgctgatcctctgcgtgacccaggtcctgatgatgcggacgacctgggccctgtgcgaggccctcaccctggcgaccggccccatctccacgctgtgggaggggaaccccggccgcttctggaacaccaccatcgccgtgagcatggccaacatcttccggggctcctacctcgccggggcgggcctgctgttcagcatcatgaagaacaccacgaacacccgccgggggaccggcaacatcggcgagaccctcggggagaagtggaagtcccgcctgaacgccctgggcaagagcgagttccagatctacaagaagtccgggatccaggaggtggaccggacgctcgccaaggagggcatcaagcgcggggagaccgaccaccacgccgtcagccggggctccgccaagctgcgctggttcgtggagcggaacatggtgaccccggagggcaaggtcgtggacctggggtgcggccgcgggggctggagctactactgcgggggcctcaagaacgtgcgggaggtcaagggcctgaccaagggcgggcccgggcacgaggagcccatccccatgtccacgtacggctggaacctggtgcgcctccagagcggggtggacgtcttcttcaccccgcccgagaagtgcgacaccctgctgtgcgacatcggcgagagctcccccaaccccaccatcgaggcgggccggacgctccgcgtgctgaacctggtggagaactggctcaacaacaacacccagttctgcatcaaggtcctgaacccgtacatgcccagcgtgatcgagaagatggagaccctgcagcggaagtacgggggcgccctggtgcgcaaccccctctcccggaacagcacccacgagatgtactgggtctccaacgccaccgggaacatcgtgagctccgtgaacatgatcagccgcatgctgatcaaccgcttcacgatgaagcacaagaaggccacctacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacgtgggcctaccacgggagctacgagaccaagcagaccggctccgcgagctccatggtgaacggggtggtccggctgctgaccaagccctgggacgtggtgccgatggtcacgcagatggccatgaccgacaccacccccttcggccagcagcgcgtgttcaaggagaaggtggacacgcggacccaggagcccaaggagggcaccaagaagctcatgcgcatcaccgccgagtggctgtggaaggagctggggaagaagaagacgccccggatgtgcacccgcgaggagttcacccggaaggtccgcagcaacgccgccctcggcgcgatcttcaccgacgagaacaagtggaagtccgcccgggaggccgtggaggacagccgcttctgggagctggtggaccgggagcgcaacctgcacctcgaggggaagtgcgagacgtgcgtctacaacatgatgggcaagcgggagaagaagctgggggagttcggcaaggccaagggctcccgcgcgatctggtacatgtggctgggggcccggttcctcgagttcgaggccctgggcttcctgaacgaggaccactggttcagccgcgggaacagcctctccggcgtggagggggagggcctgcaccggctgggctacatcctccgcgacgtcagcaagaaggagggcggggccatgtacgccgacgacaccgcggggtgggacacccggatcaccctggaggacctgaagaacgaggagatggtgacgaaccacatgaagggcgagcacaagaagctcgccgaggccatcttcaagctgacctaccagaacaaggtggtccgcgtgcagcgcccgacgccccgggggaccgtgatggacatcatctcccgccgggaccagcgcggcagcggccaggtcgggacgtacggcctgaacaccttcaccaacatggaggcccagctcatccggcagatggagggggagggcatcttcaagtccatccagcacctgaccgtgacggaggagatcgccgtgcagaactggctggcgcgcgtcggccgggagcgcctcagccggatggccatctccggggacgactgcgtggtgaagcccctggacgaccgcttcgccagcgccctgaccgccctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcgggcgggcgcgcatctcccagggcgccggctggagcctgaaggagaccgcctgcctggggaagtcctacgcccagatgtggacgctcatgtacttccaccggcgcgacctgcggctggccgcgaacgccatctgcagcgccgtcccctcccactgggtgcccaccagccgcaccacctggtccatccacgccaagcacgagtggatgaccacggaggacatgctcgcggtgtggaaccgcgtctggatccaggagaacccgtggatggaggacaagacccccgtggagagctgggaggagatcccctacctgggcaagcgggaggaccagtggtgcgggagcctgatcggcctcacctcccgcgccacctgggccaagaacatccagacggccatcaaccaggtgcggagcctgatcgggaacgaggagtacaccgactacatgccctccatgaagcgcttccggcgcgaggaggaggaggccggcgtcctgtggtga

SEQ ID NO: 9494 - RNA, 9876 nt, synthetic construct
  misc_feature 1..9876: note = derived and/or modified CDS sequence (opt1) from DENV-2__GQ868541__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggccaccatgaccgacgacatcggcatgggcgtgacctacctggccctgctcgcggccttcaaggtgcgccccacgttcgccgccgggctgctgctccggaagctgaccagcaaggagctgatgatggccaccatcggcatcgcgctcctgtcccagagcaccatccccgagacgatcctggagctcaccgacgccctggccctggggatgatggtcctcaagatcgtgcgcaacatggagaagtaccagctggccgtgaccatcatggccatctcctgcgtcccgaacgcggtgatcctgctcaacgcctggaaggtgagctgcaccatcctggccgccgtctccgtgagccccctgctcctgacgtccagccagcagaaggcggactggatccccctggccctcaccatcaagggcctgaaccccaccgccatcttcctgaccacgctctcccggaccagcaagaagcgctcctggccgctgaacgaggccgtcatggccgtgggcatggtgagcatcctggcgtccagcctcctgaagaacgacatccccatgaccgggcccctggtcgccggcgggctcctgaccgtgtgctacgtgctgacgggccggagcgccgacctcgagctggagcgcgccgccgacgtcaagtgggaggaccacgcggagatctccgggagctcccccatcctgagcatcaccatctccgaggacggcagcatgtccatcaagaacgaggaggaggagcagaccctcaccatcctgatccggacgggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcaccttccacaccatgtggcacgtcacccgcggggcggtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagacgaagcccggcctgttcaagaccaacaccgggaccatcggcgccgtcagcctggacttctcccccggcacgagcgggtcccccatcgtggaccggaagggcaaggtggtcgggctctacggcaacggcgtggtgacccgcagcggggcctacgtctccgcgatcgcccagaccgagaagtccatcgaggacaaccccgagatcgaggacgacatcttccggaagaagcgcctgaccatcatggacctgcaccccggcgccgggaagacgaagcggtacctgcccgccatcgtgcgcgaggccatcaagcggggcctccgcaccctgatcctggcgccgacccgcgtggtcgccgccgagatggaggaggccctccgggggctgcccatccgctaccagacccccgccatccgggcggagcacacgggccgcgagatcgtggacctgatgtgccacgccaccttcaccatgcggctcctgagccccgtgcgcgtcccgaactacaacctgatcatcatggacgaggcccacttcaccgaccccgcctccatcgccgcgcggggctacatcagcacgcgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgaccgacttcaaggggaagacggtctggttcgtgccgtccatcaaggccggcaacgacatcgccgcctgcctccgcaagaacggcaagaaggtgatccagctgagccggaagaccttcgactccgagtacgtcaagacccgcgccaacgactgggacttcgtggtgaccacggacatcagcgagatgggggcgaacttccgggccgagcgcgtcatcgacccccggcgctgcatgaagcccgtgatcctgaccgacggcgaggagcgggtgatcctcgccgggcccatgccggtcacccactccagcgccgcccagcgccgcggccggatcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgggagaaggtggacgccatcgacggggagtaccgcctgcggggcgaggcccgcaagacgttcgtggacctgatgcggcgcggggacctccccgtctggctggcctaccgggtggcggccgagggcatcaactacgccgaccgccggtggtgcttcgacgggatcaagaacaaccagatcctggaggagaacgtggaggtcgagatctggaccaaggagggcgagcgcaagaagctcaagccgcggtggctggacgcccgcatctacagcgaccccctggcgctcaaggagttcaaggagttcgccgccggccggaagtccctgaccctgaacctcatcaccgagatggggcgcctgcccacgttcatgacccagaaggcccgggacgccctggacaacctcgcggtgctgcacaccgccgaggccggcgggcgcgcctacaaccacgccctgagcgagctccccgagaccctggagacgctgctcctgctgaccctcctggcgaccgtcaccggcggcatcttcctgttcctcatgtccgggaagggcatcgggaagatgacgctgggcatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcaccgtggtggccgccacgatggccaacgagatggggttcctggagaagaccaagaaggacctgggcctcggcagcatcaccacccaggagagcgagtccaacatcctggacatcgacctgcgcccggccagcgcgtggacgctctacgccgtcgccaccaccttcgtgacccccatgctgcggcactccatcgagaacagctccgtgaacgtcagcctgacggccatcgcgaaccaggccaccgtgctcatggggctgggcaaggggtggcccctgtccaagatggacatcggcgtgcccctcctggccatcgggtgctacagccaggtcaacccgatcaccctgaccgccgccctcctgctgctcgtggcgcactacgccatcatcggccccggcctgcaggccaaggccacgcgcgaggcccagaagcgcgcggccgccgggatcatgaagaaccccaccgtggacggcatcaccgtcatcgacctggagcccatcccgtacgaccccaagttcgagaagcagctcggccaggtgatgctgctgatcctctgcgtgacccaggtcctgatgatgcggacgacctgggccctgtgcgaggccctcaccctggcgaccggccccatctccacgctgtgggaggggaaccccggccgcttctggaacaccaccatcgccgtgagcatggccaacatcttccggggctcctacctcgccggggcgggcctgctgttcagcatcatgaagaacaccacgaacacccgccgggggaccggcaacatcggcgagaccctcggggagaagtggaagtcccgcctgaacgccctgggcaagagcgagttccagatctacaagaagtccgggatccaggaggtggaccggacgctcgccaaggagggcatcaagcgcggggagaccgaccaccacgccgtcagccggggctccgccaagctgcgctggttcgtggagcggaacatggtgaccccggagggcaaggtcgtggacctggggtgcggccgcgggggctggagctactactgcgggggcctcaagaacgtgcgggaggtcaagggcctgaccaagggcgggcccgggcacgaggagcccatccccatgtccacgtacggctggaacctggtgcgcctccagagcggggtggacgtcttcttcaccccgcccgagaagtgcgacaccctgctgtgcgacatcggcgagagctcccccaaccccaccatcgaggcgggccggacgctccgcgtgctgaacctggtggagaactggctcaacaacaacacccagttctgcatcaaggtcctgaacccgtacatgcccagcgtgatcgagaagatggagaccctgcagcggaagtacgggggcgccctggtgcgcaaccccctctcccggaacagcacccacgagatgtactgggtctccaacgccaccgggaacatcgtgagctccgtgaacatgatcagccgcatgctgatcaaccgcttcacgatgaagcacaagaaggccacctacgagccggacgtcgacctgggctccgggacccggaacatcggcatcgagagcgagatccccaacctcgacatcatcggcaagcgcatcgagaagatcaagcaggagcacgagacctcctggcaccacgaccaggaccacccctacaagacgtgggcctaccacgggagctacgagaccaagcagaccggctccgcgagctccatggtgaacggggtggtccggctgctgaccaagccctgggacgtggtgccgatggtcacgcagatggccatgaccgacaccacccccttcggccagcagcgcgtgttcaaggagaaggtggacacgcggacccaggagcccaaggagggcaccaagaagctcatgcgcatcaccgccgagtggctgtggaaggagctggggaagaagaagacgccccggatgtgcacccgcgaggagttcacccggaaggtccgcagcaacgccgccctcggcgcgatcttcaccgacgagaacaagtggaagtccgcccgggaggccgtggaggacagccgcttctgggagctggtggaccgggagcgcaacctgcacctcgaggggaagtgcgagacgtgcgtctacaacatgatgggcaagcgggagaagaagctgggggagttcggcaaggccaagggctcccgcgcgatctggtacatgtggctgggggcccggttcctcgagttcgaggccctgggcttcctgaacgaggaccactggttcagccgcgggaacagcctctccggcgtggagggggagggcctgcaccggctgggctacatcctccgcgacgtcagcaagaaggagggcggggccatgtacgccgacgacaccgcggggtgggacacccggatcaccctggaggacctgaagaacgaggagatggtgacgaaccacatgaagggcgagcacaagaagctcgccgaggccatcttcaagctgacctaccagaacaaggtggtccgcgtgcagcgcccgacgccccgggggaccgtgatggacatcatctcccgccgggaccagcgcggcagcggccaggtcgggacgtacggcctgaacaccttcaccaacatggaggcccagctcatccggcagatggagggggagggcatcttcaagtccatccagcacctgaccgtgacggaggagatcgccgtgcagaactggctggcgcgcgtcggccgggagcgcctcagccggatggccatctccggggacgactgcgtggtgaagcccctggacgaccgcttcgccagcgccctgaccgccctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcgggcgggcgcgcatctcccagggcgccggctggagcctgaaggagaccgcctgcctggggaagtcctacgcccagatgtggacgctcatgtacttccaccggcgcgacctgcggctggccgcgaacgccatctgcagcgccgtcccctcccactgggtgcccaccagccgcaccacctggtccatccacgccaagcacgagtggatgaccacggaggacatgctcgcggtgtggaaccgcgtctggatccaggagaacccgtggatggaggacaagacccccgtggagagctgggaggaggtgccctacctgggcaagcgggaggaccagtggtgcgggagcctgatcggcctcacctcccgcgccacctgggccaagaacatccagacggccatcaaccaggtccggagcctgatcgggaacgaggagtacaccgactacatgccctccatgaagcgcttccggcgcgaggaggaggaggccggcgtgctgtggtga

SEQ ID NO: 9495 - RNA, 9876 nt, synthetic construct
  misc_feature 1..9876: note = derived and/or modified CDS sequence (opt1) from DENV-2__GQ868603__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccgcaccggcctggacttcaacgagatggtgctcctgcagatggaggacaaggcctggctggtccaccggcagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcgcggcgccaagcggatggccatcctcggggacaccgcctgggacttcggcagcctcggcggggtgttcacctccatcgggaaggccctgcaccaggtcttcggggcgatctacggcgccgccttcagcggggtgtcctggaccatgaagatcctgatcggcgtgatcatcacgtggatcgggatgaacagccgctccaccagcctctccgtcagcctggtgctggtgggcgtcgtgaccctctacctgggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctcgcctccgccatccagaaggcccacgaggagggcatctgcgggatccggagcgtcacccgcctggagaacctgatgtggaagcagatcacccccgagctcaaccacatcctgtccgagaacgaggtgaagctgacgatcatgaccggcgacatcaaggggatcatgcaggccggcaagcggagcctccgcccgcagcccaccgagctgaagtactcctggaagacctggggcaaggcgaagatgctgagcacggagtcccacaaccagaccttcctcatcgacgggcccgagaccgccgagtgcccgaacaccaaccgggcctggaacagcctggaggtggaggactacggcttcggggtcttcacgaccaacatctggctgaagctccgcgagaagcaggacgtgctgtgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtcgtggtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgccgccgtgagcttcgtgacgctgatcaccgggaacatgtccttccgggacctgggccgcgtcatggtgatggtgggggccaccatgaccgacgacatcggcatgggcgtcacgtacctcgccctgctggcggccttcaaggtgcgccccaccttcgccgccgggctcctgctgcggaagctcaccagcaaggagctgatgatggccaccatcggcatcgcgctgctctcccagagcacgatccccgagaccatcctggagctgaccgacgccctcgccctggggatgatggtgctgaagatcgtccgcaacatggagaagtaccagctcgtggtgaccatcatggccatctcctgcgtcccgaacgccgtgatcctgcagaacgcgtggaaggtgagctgcacgatcctggccgccgtctccgtgagccccctcctgctgacctccagccggcagaaggccgactggatccccctcgcgctgaccatcaagggcctgaaccccaccgccatcttcctcacgaccctgtcccgcaccagcaagaagcggtcctggccgctgaacgaggccatcatggccgtcggcatggtgagcatcctcgcctccagcctgctgaagaacgacatccccatgaccgggcccctcgtggcgggcgggctgctgacggtctgctacgtgctcaccggccgcagcgccgacctggagctggagcgggccgccgacgtgaagtgggaggaccaggccgagatctccgggagctcccccatcctcagcatcaccatctccgaggacggcagcatgtccatcaagaacgaggaggaggagcagaccctgacgatcctgatccgcaccggcctcctggtcatcagcggggtgttcccggtgtccatccccatcaccgcggccgcctggtacctgtgggaggtcaagaagcagcgggccggcgtgctctgggacgtgcccagcccgccgcccgtcgggaaggccgagctggaggacggcgcgtaccgcatcaagcagcgggggatcctgggctactcccagatcggcgccggggtgtacaaggagggcaccttccacaccatgtggcacgtgacgcgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggcggtgcagaccaagcccggcctgttcaagaccaacaccgggacgatcggcgccgtgagcctcgacttctcccccggcaccagcgggtcccccatcgtcgaccgcaagggcaaggtggtggggctgtacggcaacggcgtcgtgacccggagcggggcctacgtgtccgccatcgcgcagaccgagaagtccatcgaggacaaccccgagatcgaggacgacatcttccgcaagaagcggctgacgatcatggacctgcaccccggcgccgggaagaccaagcgctacctccccgccatcgtccgggaggccatcaagcgcggcctgcgcaccctgatcctcgccccgacccgggtggtggcggccgagatggaggaggccctgcgcgggctgcccatccggtaccagacgcccgccatccgcgccgagcacaccggccgggagatcgtcgacctcatgtgccacgcgaccttcaccatgcgcctgctgagccccgtgcgggtgccgaactacaacctcatcatcatggacgaggcccacttcacggaccccgcctccatcgccgcccgcggctacatcagcacccgggtcgagatgggggaggcggccggcatcttcatgaccgccacgccgcccgggtcccgcgacccgttcccccagagcaacgcccccatcatggacgaggagcgggagatccccgagcgctcctggaacagcggccacgagtgggtgacggacttcaaggggaagaccgtgtggttcgtcccgtccatcaaggcgggcaacgacatcgccgcctgcctgcggaagaacggcaagaaggtgatccagctgagccgcaagaccttcgactccgagtacgtgaagacccgggccaacgactgggacttcgtcgtgacgaccgacatcagcgagatgggggccaacttcaaggcggagcgcgtgatcgacccccggcgctgcatgaagcccgtcatcctcaccgacggcgaggagcgggtgatcctggccgggcccatgccggtgacccactccagcgccgcccagcgccgcggccggatcgggcgcaaccccaagaacgagaacgaccagtacatctacatgggcgagcccctggagaacgacgaggactgcgcccactggaaggaggcgaagatgctcctggacaacatcaacacgcccgagggcatcatcccgtccatgttcgagcccgagcgggagaaggtcgacgccatcgacggggagtaccgcctgcggggcgaggcccgcaagaccttcgtggacctcatgcggcgcggggacctgcccgtgtggctggcctaccgggtcgccgcggagggcatcaactacgccgaccgccggtggtgcttcgacgggatcaagaacaaccagatcctcgaggagaacgtggaggtggagatctggaccaaggagggcgagcgcaagaagctgaagccgcggtggctggacgcccgcatctacagcgaccccctcgccctgaaggagttcaaggagttcgcggccggccggaagtccctgaccctcaacctgatcacggagatggggcgcctgcccaccttcatgacccagaaggcccgggacgccctcgacaacctggccgtcctgcacaccgcggaggccggcgggcgcgcctacaaccacgccctcagcgagctgcccgagacgctggagaccctcctgctgctcaccctgctggccaccgtgacgggcggcatcttcctcttcctgatgtccgggaagggcgtcgggaagatgaccctgggcatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacctacgtggtcatcgccatcctgacggtggtggcggccaccatggccaacgagatggggttcctggagaagaccaagaaggacctcggcctgggcagcatcaccacgcaggagagcgagtccaacatcctggacatcgacctccgcccggccagcgcctggaccctgtacgcggtcgccaccaccttcttcacgcccatgctgcggcactccatcgagaacagctccgtgaacgtgagcctcaccgccatcgccaaccaggcgaccgtcctgatggggctgggcaaggggtggcccctctccaagatggacatcggcgtgcccctgctggccatcgggtgctacagccaggtgaacccgatcaccctcacggccgccctgctgctcctggtcgcccactacgcgatcatcggccccggcctgcaggccaaggccacccgcgaggcccagaagcgcgccgcggccgggatcatgaagaaccccaccgtggacggcatcaccgtgatcgacctcgagcccatcccgtacgaccccaagttcgagaagcagctggggcaggtcatgctgctcatcctgtgcgtgacccaggtgctgatgatgcggaccacctgggccctctgcgaggccctgaccctggccacgggccccatctccaccctctgggaggggaaccccggccgcttctggaacaccaccatcgcggtcagcatggccaacatcttccggggctcctacctggccggggccggcctgctgttcagcatcatgaagaacacgaccaacacccgccgggggaccggcaacatcggcgagacgctgggggagaagtggaagtcccgcctgaacgcgctcggcaagagcgagttccagatctacaagaagtccgggatccaggaggtggaccggaccctggccaaggagggcatcaagcgcggggagaccgaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgacgaagggcggccccgggcacgaggagcccatccccatgtccacctacggctggaacctcgtccgcctgcagagcggggtggacgtgttcttcaccccgcccgagaagtgcgacaccctgctctgcgacatcggcgagagctcccccaaccccacgatcgaggccggccggaccctgcgcgtcctgaacctcgtggagaactggctgaacaacaacacccagttctgcatcaaggtgctgaacccgtacatgcccagcgtcatcgagaagatggagaccctgcagcggaagtacgggggcgcgctcgtgcgcaaccccctgtcccggaacagcacccacgagatgtactgggtgtccaacgccacggggaacatcgtcagctccgtgaacatgatcagccgcatgctgatcaaccgcttcaccatgaagcacaagaaggccacctacgagccggacgtggacctcggctccgggacccggaacatcggcatcgagagcgagatccccaacctggacatcatcggcaagcgcatcgagaagatcaagcaggagcacgagacgtcctggcactacgaccaggaccacccctacaagacctgggcctaccacgggagctacgagaccaagcagaccggctccgccagctccatggtcaacggggtggtgcggctgctcacgaagccctgggacgtcgtgccgatggtgacccagatggcgatgaccgacaccacgcccttcggccagcagcgcgtcttcaaggagaaggtggacacccggacccaggagcccaaggagggcaccaagaagctgatgaagatcacggccgagtggctgtggaaggagctcgggaagaagaagatcccccgcatgtgcacccgggaggagttcacccgcaaggtgcggagcaacgccgccctgggcgccatcttcaccgacgagaacaagtggaagtccgcgcgcgaggccgtcgaggacagccggttctgggagctggtggaccgcgagcggaacctccacctggaggggaagtgcgagacgtgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtcgagggggagggcctgcaccgcctcggctacatcctgcgggacgtgagcaagaaggagggcggcgccatgtacgccgacgacaccgccgggtgggacacccgcatcaccctggaggacctcaagaacgaggagatggtcacgaaccacatgaagggcgagcacaagaagctggcggaggccatcttcaagctgacctaccagaacaaggtggtgcgggtccagcgcccgacgccccgcgggaccgtgatggacatcatctcccggcgcgaccagcggggcagcggccaggtggggacgtacggcctcaacaccttcaccaacatggaggcccagctgatccgccagatggagggggagggcatcttcaagtccatccagcacctgaccgtcacggaggagatcgccgtgcagaactggctcgcccgggtgggccgcgagcggctgagccgcatggcgatctccggggacgactgcgtcgtgaagcccctggacgaccggttcgccagcgccctcaccgccctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgcgggctggagcctgaaggagaccgcctgcctcgggaagtcctacgcccagatgtggacgctgatgtacttccaccgccgggacctgcgcctcgccgccaacgcgatctgcagcgccgtgccctcccactgggtccccaccagccggaccacctggtccatccacgccaagcacgagtggatgaccacggaggacatgctggccgtgtggaaccgcgtgtggatccaggagaacccgtggatggaggacaagacccccgtcgagagctgggaggaggtgccctacctgggcaagcgcgaggaccagtggtgcgggagcctcatcggcctgacctcccgggcgacctgggccaagaacatccagacggccatcaaccaggtgcgcagcctgatcgggaacgaggagtacaccgactacatgccctccatgaagcggttccgccgggaggaggaggaggccggcgtcctctggtga

SEQ ID NO: 9496 - RNA, 9876 nt, synthetic construct
  misc_feature 1..9876: note = derived and/or modified CDS sequence (opt1) from DENV-2__FJ898450__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtggaggactacggcttcggggtcttcacgaccaacatctggctgaagctgcgcgagaagcaggacgccttctgcgactccaagctcatgagcgccgcgatcaaggacaaccgggccgtgcacgccgacatgggctactggatcgagtccgccctgaacgacacctggaagatggagaaggccagcttcatcgaggtgaagtcctgccactggcccaagagccacaccctgtggtccaacggcgtcctcgagagcgagatgatcatccccaagaacttcgcggggcccgtgtcccagcacaactaccgcccgggctaccacacccagacggccgggccctggcacctgggcaagctggagatggacttcgacttctgcgaggggaccaccgtggtcgtgaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacccgcgtgggcaccaagcacgccatcctcctggtcgccgtgagcttcgtgacgctgatcaccgggaacatgtccttccgggacctcggccgcgtcatggtgatggtgggggccaccatgaccgacgacatcggcatgggcgtcacgtacctggccctgctcgcggccttcaaggtgcgccccaccttcgccgccgggctgctgctccggaagctgaccagcaaggagctgatgatggccaccatcggcatcgcgctcctgtcccagagcacgatccccgagaccatcctggagctcaccgacgccctggccctggggatgatggtgctcaagatcgtccgcaacatggagaagtaccagctggccgtgaccatcatggccatctcctgcgtgccgaacgcggtcatcctgcagaacgcctggaaggtgagctgcacgatcctcgccgccgtgtccgtcagccccctgctgctcacctccagccagcagaaggcggactggatccccctggccctgaccatcaagggcctcaaccccaccgccatcttcctgacgaccctgtcccggaccagcaagaagcgctcctggccgctcaacgaggccgtgatggccgtcggcatggtgagcatcctggcgtccagcctgctcaagaacgacatccccatgaccgggcccctggtggccggcgggctgctcacggtctgctacgtgctgaccggccggagcgccgacctggagctcgagcgcgccgccgacgtgaagtgggaggaccaggcggagatctccgggagctcccccatcctgagcatcaccatctccgaggacggcagcatgtccatcaagaacgaggaggaggagcagaccctgacgatcctcatccggaccggcctgctggtcatcagcggggtgttcccggtgtccatccccatcaccgccgccgcctggtacctctgggaggtcaagaagcagcgcgccggcgtgctgtgggacgtgcccagcccgccgcccgtcgggaaggcggagctggaggacggcgcctaccggatcaagcagcgcgggatcctcggctactcccagatcggcgccggggtgtacaaggagggcaccttccacaccatgtggcacgtgacgcgcggggcggtcctgatgcaccgcggcaagcggatcgagcccagctgggccgacgtgaagaaggacctgatctcctacgggggcggctggaagctcgagggggagtggaaggagggcgaggaggtgcaggtcctggcgctggagcccgggaagaacccccgcgccgtgcagaccaagcccggcctcttcaagaccaacaccgggacgatcggcgccgtgagcctggacttctcccccggcaccagcgggtcccccatcgtcgaccggaagggcaaggtggtggggctgtacggcaacggcgtcgtgacccgcagcggggcctacgtgtccgcgatcgcccagaccgagaagtccatcgaggacaaccccgagatcgaggacgacatcttccggaagaagcgcctcacgatcatggacctgcaccccggcgccgggaagaccaagcggtacctgcccgccatcgtccgcgaggccatcaagcggggcctgcgcaccctcatcctggcgccgacccgcgtggtggccgccgagatggaggaggccctgcgggggctccccatccgctaccagacgcccgccatccgggcggagcacaccggccgcgagatcgtcgacctgatgtgccacgccaccttcaccatgcggctgctcagccccgtgcgcgtgccgaactacaacctgatcatcatggacgaggcccacttcacggaccccgcctccatcgccgcgcggggctacatcagcacccgcgtcgagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgacggacttcaaggggaagaccgtgtggttcgtcccgtccatcaaggccggcaacgacatcgccgcctgcctgcgcaagaacggcaagaaggtgatccagctcagccggaagaccttcgactccgagtacgtgaagacccgcgccaacgactgggacttcgtcgtgacgaccgacatcagcgagatgggggcgaacttccgggccgagcgcgtgatcgacccccggcgctgcatgaagcccgtcatcctgaccgacggcgaggagcgggtgatcctggccgggcccatgccggtgacccactccagcgccgcccagcgccgcggccggatcgggcgcaaccccaagaacgagaacgaccagtacatctacatgggcgagcccctcgagaacgacgaggactgcgcgcactggaaggaggccaagatgctgctggacaacatcaacacgcccgagggcatcatcccgtccatgttcgagcccgagcgggagaaggtcgacgccatcgacggggagtaccgcctccggggcgaggcccgcaagaccttcgtggacctgatgcggcgcggggacctgcccgtgtggctcgcctaccgggtcgcggccgagggcatcaactacgccgaccgccggtggtgcttcgacgggatcaagaacaaccagatcctggaggagaacgtggaggtggagatctggaccaaggagggcgagcgcaagaagctgaagccgcggtggctcgacgcccgcatctacagcgaccccctggcgctgaaggagttcaaggagttcgccgccggccggaagtccctcaccctgaacctgatcacggagatggggcgcctccccaccttcatgacccagaaggcccgggacgccctggacaacctggcggtcctccacaccgccgaggccggcgggcgcgcctacaaccacgccctgagcgagctgcccgagacgctcgagaccctgctgctcctgaccctgctcgcgaccgtgacgggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtcctgctcatccccgagcccgagaagcagcggacgccccaggacaaccagctgacctacgtggtgatcgcgatcctgacggtcgtggccgccaccatggccaacgagatggggttcctcgagaagaccaagaaggacctgggcctgggcagcatcaccacgcaggagagcgagtccaacatcctcgacatcgacctgcgcccggccagcgcgtggaccctgtacgccgtggccaccaccttcgtcacgcccatgctccggcactccatcgagaacagctccgtgaacgtgagcctgaccgccatcgcgaaccaggccaccgtcctgatggggctcggcaaggggtggcccctgtccaagatggacatcggcgtgcccctgctcgccatcgggtgctacagccaggtgaacccgatcaccctgacggccgccctgctcctgctggtcgcgcactacgccatcatcggccccggcctccaggccaaggccacccgcgaggcccagaagcgcgcggccgccgggatcatgaagaaccccaccgtggacggcatcaccgtgatcgacctggagcccatcccgtacgaccccaagttcgagaagcagctggggcaggtcatgctcctgatcctgtgcgtgacccaggtgctcatgatgcggaccacctgggccctgtgcgaggccctgaccctcgcgacgggccccatctccaccctgtgggaggggaaccccggccgcttctggaacaccaccatcgccgtcagcatggccaacatcttccggggctcctacctggccggggcgggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtgagccggggctccgccaagctccgctggttcgtcgagcggaacatggtgaccccggagggcaaggtggtcgacctggggtgcggccgcgggggctggagctactactgcgggggcctgaagaacgtgcgggaggtgaagggcctcacgaagggcgggcccgggcacgaggagcccatccccatgtccacctacggctggaacctggtccgcctgcagagcggggtggacgtgttcttcaccccgcccgagaagtgcgacaccctcctgtgcgacatcggcgagagctcccccaaccccacgatcgaggcgggccggaccctgcgcgtcctcaacctggtggagaactggctgaacaacaacacccagttctgcatcaaggtgctcaacccgtacatgcccagcgtcatcgagaagatggagaccctgcagcggaagtacgggggcgccctggtgcgcaaccccctgtcccggaacagcacccacgagatgtactgggtgtccaacgccacggggaacatcgtcagctccgtgaacatgatcagccgcatgctcatcaaccgcttcaccatgaagcacaagaaggccacctacgagccggacgtggacctgggctccgggacccggaacatcggcatcgagagcgagatccccaacctggacatcatcggcaagcgcatcgagaagatcaagcaggagcacgagacgtcctggcactacgaccaggaccacccctaccggacctgggcctaccacgggagctacgagaccaagcagaccggctccgcgagctccatggtcaacggggtggtgcgcctcctgacgaagccctgggacgtcgtgccgatggtgacccagatggccatgaccgacaccacgcccttcggccagcagcgggtcttcaaggagaaggtggacacccgcacccaggagcccaaggagggcaccaagaagctgatgcggatcacggccgagtggctctggaaggagctggggaagaagaagacgccccgcatgtgcacccgggaggagttcacccgcaaggtgcggagcaacgccgccctgggcgcgatcttcacggacgagaacaagtggaagtccgcccgcgaggccgtcgaggacagccggttctgggagctcgtggaccgcgagcggaacctgcacctggaggggaagtgcgagacctgcgtgtacaacatgatgggcaagcgcgagaagaagctcggggagttcggcaaggccaagggctcccgggcgatctggtacatgtggctgggggcccgcttcctggagttcgaggccctcggcttcctgaacgaggaccactggttcagccgggggaacagcctgtccggcgtcgagggggagggcctccaccgcctgggctacatcctgcgggacgtgagcaagaaggagggcggggccatgtacgccgacgacaccgcggggtgggacacccgcatcacgctcgaggacctgaagaacgaggagatggtcaccaaccacatgaagggcgagcacaagaagctggccgaggccatcttcaagctcacctaccagaacaaggtggtgcgcgtccagcggccgacgccccgcgggacggtgatggacatcatctcccggcgcgaccagcggggcagcggccaggtggggacctacggcctgaacaccttcaccaacatggaggcccagctgatccgccagatggagggggagggcatcttcaagtccatccagcacctcacggtcaccgaggagatcgccgtgcagaactggctggcgcgggtgggccgcgagcggctgagccgcatggccatctccggggacgactgcgtcgtgaagcccctcgacgaccggttcgccagcgccctgaccgccctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcgggcgcgcgcggatctcccagggcgccggctggagcctcaaggagacggcctgcctggggaagtcctacgcccagatgtggaccctgatgtacttccaccgccgggacctccgcctggccgcgaacgccatctgcagcgccgtgccctcccactgggtccccaccagccgcaccacctggtccatccacgccaagcacgagtggatgacgaccgaggacatgctggcggtgtggaaccgggtgtggatccaggagaacccgtggatggaggacaagacccccgtcgagagctgggaggaggtgccctacctcggcaagcgcgaggaccagtggtgcgggagcctgatcggcctgacctcccgggccacgtgggccaagaacatccagaccgccatcaaccaggtgcgcagcctcatcgggaacgaggagtacaccgactacatgccctccatgaagcggttccgccgggaggaggaggaggccggcgtcctgtggtga

SEQ ID NO: 9497 - RNA, 9876 nt, synthetic construct
  misc_feature 1..9876: note = derived and/or modified CDS sequence (opt1) from DENV-2__FJ898453__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccgcaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttctccaccaacatctggctcaagctgcgcgagcggcaggacgtgttctgcgacagcaagctgatgtccgccgccatcaaggacaaccgcgcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccggccgggctaccacacgcagaccgcggggccctggcacctcggcaagctggagatggacttcgacttctgcgaggggaccaccgtcgtggtgacggaggactgcggcaaccgcggccccagcctgcggaccaccaccgcctccgggaagctcatcacggagtggtgctgccgcagctgcaccctgcccccgctgcggtaccgcggcgaggacgggtgctggtacggcatggagatccggcccctcaaggagaaggaggagaacctggtcaactccctggtgaccgccgggcacggccagatcgacaacttcagcctcggcgtgctggggatggccctgttcctcgaggagatgctgcgcacccgggtcggcacgaagcacgcgatcctgctcgtggccctgtccttcgtgaccctgatcaccgggaacatgagcttccgcgacctcggccgcgtcatggtgatggtgggggccaccatgacggacgacatcggcatgggcgtcacctacctggccctgctcgccgcgttcaaggtgcggcccaccttcgccgccgggctgctgctccgcaagctgacctccaaggagctgatgatggccacgatcggcatcgccctcctgagccagtccaccctgcccgagaccatcctcgagctgaccgacgcgctggccctcgggatgatggtgctgaagatcgtccggaacatggagaagtaccagctggccgtgacgatcatggccatcagctgcgtgccgaacgccgtcatcctccagaacgcgtggaaggtgtcctgcaccatcctggccgccgtgagcgtcagccccctgctcctgaccagctcccagcagaaggccgactggatccccctggcgctcaccatcaagggcctgaaccccacggccatcttcctgaccaccctcagccgcacctccaagaagcggagctggccgctgaacgaggccatcatggccgtgggcatggtctccatcctggccagcagcctcctgaagaacgacatccccatgacggggcccctggtggcgggcgggctcctgaccgtgtgctacgtcctgaccggccgctccgccgacctcgagctggagcgggccgccgacgtgaagtgggaggaccaggccgagatcagcgggtccagccccatcctgtccatcaccatcagcgaggacggctccatgagcatcaagaacgaggaggaggagcagacgctcaccatcctgatccgcaccggcctgctcgtgatctccggggtcttcccggtgagcatccccatcaccgcggccgcctggtacctgtgggaggtgaagaagcagcgggccggcgtcctgtgggacgtgcccagcccgccgcccgtggggaaggccgagctcgaggacggcgtctaccgcatcaagcagcgggggatcctgggctacagccagatcggcgcgggggtgtacaaggagggcaccttccacacgatgtggcacgtgacccgcggggccgtcctgatgcaccggggcaagcgcatcgagccctcctgggccgacgtgaagaaggacctcatcagctacgggggcggctggaagctggagggggagtggaaggagggcgaggaggtgcaggtcctggccctcgagcccgggaagaacccccgggccgtgcagaccaagcccggcatcttcaagaccaacacggggaccatcggcgcggtgtccctggacttcagccccggcacctccgggagccccatcgtcgaccgcaagggcaaggtggtggggctgtacggcaacggcgtcgtgacccggtccggggcctacgtgagcgccatcgcccagacggagaagtccatcgaggacaaccccgagatcgaggacgacatcttccgcaagaagcggctcaccatcatggacctgcaccccggcgcggggaagaccaagcgctacctgcccgccatcgtccgggaggccatcaagcgcggcctgcgcaccctcatcctggccccgacgcgggtggtggccgcggagatggaggaggccctgcgcgggctccccatccggtaccagacccccgccatccgcgccgagcacaccggccgggagatcgtcgacctgatgtgccacgccaccttcacgatgcgcctgctctcccccgtgcgggtgccgaactacaacctgatcatcatggacgaggcgcacttcaccgaccccgccagcatcgccgcccgcggctacatctccacccgggtcgagatgggggaggccgcgggcatcttcatgaccgccacgccgcccgggagccgcgacccgttcccccagtccaacgcccccatcatggacgaggagcgggagatccccgagcgcagctggaactccggccacgagtgggtgaccgacttcaaggggaagaccgtgtggttcgtcccgagcatcaaggccggcaacgacatcgcggcctgcctgcggaagaacggcaagaaggtgatccagctctcccgcaagaccttcgacagcgagtacgtgaagacgcgggccaacgactgggacttcgtcgtgaccaccgacatctccgagatgggggccaacttcaaggccgagcgcgtgatcgacccccggcgctgcatgaagcccgtcatcctgaccgacggcgaggagcgggtgatcctggcggggcccatgccggtgacgcacagctccgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgggagaaggtcgacgcgatcgacggggagtaccgcctccggggcgaggcccgcaagaccttcgtggacctgatgcggcgcggggacctgcccgtgtggctcgcctacaaggtcgccgccgagggcatcaactacgcggaccggaagtggtgcttcgacgggatcaagaacaaccagatcctggaggagaacgtggaggtggagatctggaccaaggagggcgagcgcaagaagctgaagccgcggtggctcgacgcccgcatctactccgaccccctggccctgaaggagttcaaggagttcgccgcgggccggaagtccctcacgctgaacctgatcaccgagatggggcgcctccccaccttcatgacccagaaggcccggaacgccctggacaacctggccgtcctccacacggccgaggtgggcgggcgcgcgtacaaccacgccctgtccgagctgcccgagaccctcgagaccctgctgctcctgaccctgctcgccacggtcaccggcggcatcttcctgttcctgatgagcgggaagggcatcgggaagatgaccctcggcatgtgctgcatcatcaccgcctccatcctgctgtggtacgcccagatccagccgcactggatcgcggccagcatcatcctcgagttcttcctgatcgtgctgctcatccccgagcccgagaagcagcggacgccccaggacaaccagctgacgtacgtggtcatcgccatcctgaccgtggtggccgccaccatggcgaacgagatggggttcctcgagaagaccaagaaggacctgggcttcggcagcatcacgacccaggagtccgagagcaacatcctggacatcgacctccgcccggcctccgcctggaccctgtacgccgtcgccaccacgttcgtgacccccatgctgcggcacagcatcgagaactccagcgtgaacgtctccctcaccgcgatcgccaaccaggccaccgtgctgatggggctgggcaaggggtggcccctcagcaagatggacatcggcgtgcccctgctggccatcgggtgctactcccaggtcaacccgatcacgctcaccgcggccctgctgctcctggtggcccactacgccatcatcggccccggcctgcaggccaaggcgacccgcgaggcccagaagcgggccgccgccgggatcatgaagaaccccaccgtggacggcatcacggtcatcgacctcgagcccatcccgtacgaccccaagttcgagaagcagctggggcaggtcatgctgctcatcctgtgcgtgacccaggtcctgatgatgcgcaccacctgggcgctctgcgaggccctgacgctggccaccggccccatcagcaccctctgggaggggaaccccggccgcttctggaacaccacgatcgccgtgtccatggccaacatcttccggggcagctacctggcgggggccggcctcctgttctccatcatgaagaacaccaccaacacccgccgggggacgggcaacgtgggcgagaccctgggggagaagtggaagtcccgcctgaacgccctcggcaagtccgagttccagatctacaagaagtccgggatccaggaggtcgaccggaccctggccaaggagggcatcaagcgcggggagaccgaccaccacgcggtgtcccggggcagcgccaagctgcgctggttcgtggagcggaacatggtcgccccggagggcaaggtggtggacctcgggtgcggccgcgggggctggtcctactactgcgggggcctgaagaacgtccgggaggtgaagggcctgacgaagggcgggcccgggcacgaggagcccatccccatgagcacctacggctggaacctcgtgcgcctgcagagcggggtcgacgtgttcttcaccccgcccgagaagtgcgacaccctgctctgcgacatcggcgagtccagccccaaccccacgatcgaggccggccggaccctgcgcgtgctgaacctcgtcgagaactggctgaacaacaacacccagttctgcatcaaggtgctgaacccgtacatgccctccgtgatcgagaagatggagaccctccagcggaagtacgggggcgccctggtccgcaaccccctgagccggaactccacccacgagatgtactgggtgagcaacgcgacggggaacatcgtgtccagcgtcaacatgatctcccgcatgctgatcaaccggttcaccatgaagcacaagaaggccacctacgagccggacgtggacctcggcagcgggacccgcaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcctccagcatggtgaacggggtcgtgcggctgctcacgaagccctgggacgtggtcccgatggtgacccagatggccatgaccgacaccacgcccttcggccagcagcgcgtgttcaaggagaaggtcgacacccggacccaggagcccaaggagggcaccaagaagctgatgaagatcacggcggagtggctgtggaaggagctcgggaaggagaagacgccccgcatgtgcacccgggaggagttcacccgcaaggtgcggtccaacgccgccctgggcgccatcttcacggacgagaacaagtggaagtccgcccgcgaggcggtggaggacgggcggttctgggagctggtcgaccgcgagcggaacctccacctggagggcaagtgcgagacctgcgtgtacaacatgatggggaagcgcgagaagaagctgggcgagttcggcaaggccaaggggtcccgggccatctggtacatgtggctcggcgcccgcttcctggagttcgaggcgctggggttcctcaacgaggaccactggttcagccggggcaacagcctgtccggggtcgagggcgagggcctgcaccgcctcgggtacatcctgcgggaggtgggcaagaaggagggcggcgccatgtacgccgacgacaccgccgggtgggacacccgcatcacgctggaggacctcaagaacgaggagatggtgaccaaccacatgaagggcgagcacaagaagctggccgaggcgatcttcaagctgacctaccagaacaaggtcgtgcgggtgcagcgcccgacgccccggggcacggtcatggacatcatcagccgcaaggaccagcgcgggtccggccaggtggggacctacggcctcaacaccttcaccaacatggaggcccagctgatccggcagatggagggcgaggggatcttcaagagcatccagcacctgacggtgaccgaggagatcgccgtccagaactggctcgcccgcgtgggccgggagcgcctgtcccggatggccatcagcggggacgactgcgtggtcaagcccatcgacgaccgcttcgcgtccgccctgaccgccctcaacgacatgggcaaggtgcggaaggacatccagcagtgggagcccagccgcgggtggaacgactggacccaggtgccgttctgctcccaccacttccacgagctggtcatgaaggacggccgggtgctggtggtcccctgccgcaaccaggacgagctcatcggccgggcccgcatcagccagggggccggctggtccctgaaggagacggcgtgcctgggcaagagctacgcccagatgtggaccctcatgtacttccaccggcgcgacctgcggctggccgccaacgccatctgctccgcggtgcccagccactgggtgcccacctcccgcaccacctggagcatccacgccaagcacgagtggatgacgaccgaggacatgctcgccgtctggaaccgggtgtggatccaggagaacccgtggatggaggacaagacccccgtggagtcctgggaggaggtcccctacctgggcaagcgcgaggaccagtggtgcgggagcctgatcggcctcaccagccgggccacgtgggcgaagaacatccagaccgccatcaaccaggtgcgctccctgatcggcaacgaggagtacaccgactacatgcccagcatgaagcgcttccggcgcgaggaggaggaggccggggtgctgtggtga

SEQ ID NO: 9498 - RNA, 9876 nt, synthetic construct
  misc_feature 1..9876: note = derived and/or modified CDS sequence (opt1) from DENV-2__EU482445__SS-prME
  source 1..9876: mol_type = other RNA
agcgccgggatgatcatcatgctgatccccaccgtgatggccttccacctcaccacccggaacggggagccgcacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccctgaagatcctgatcggggtgatcatcacctggatcggcatgaactcccggagcacctccctgagcgtctccctcgtgctggtggggatcgtcacgctgtacctcggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctcgagaacctgatgtggaagcagatcacccccgagctgaaccacatcctcgccgagaacgaggtgaagctgaccatcatgaccggggacatcaagggcatcatgcaggccgggaagcgcagcctgcggccgcagcccacggagctcaagtactcctggaagacctggggcaaggccaagatgctgagcaccgagtcctacaaccagaccttcctgatcgacggccccgagacgaccgagtgcccgaacaccaaccgcgcgtggaacagcctcgaggtggaggactacgggttcggcgtcttcaccacgaacatctggctgaagctgaaggagaagcaggacgccttctgcgactccaagctcatgagcgccgccatcaaggacaaccgggccgtgcacgcggacatggggtactggatcgagtccgccctgaacgacacctggaagatcgagaaggccagcttcatcgaggtgaagaactgccactggcccaagtcccacaccctgtggagcaacggcgtcctcgagtccgagatgatcatccccaagaacctggccggccccgtgagccagcacaactaccgcccggggtaccacacccagatcgccggcccctggcacctggggaagctcgagatggacttcgacttctgcgacggcaccacggtgatcgtcaccgaggactgcgggaaccggggcccctccctgcgcaccaccacggcgagcggcaagctgatcaccgagtggtgctgccggagctgcaccctcccgcccctgcgctaccgcggggaggacggctgctggtacgggatggagatccgccccctgaaggagaaggaggagaacctcgtgaactccctggtgaccgccggccacgggcaggtcgacaacttcagcctgggcgtgctcggcatggccctgttcctggaggagatgctccggacgcgcgtggggaccaagcacgccatcctgctggtcgcggtgtccttcgtgaccctcatcaccggcaacatgagcttcaaggacctggggcgggtcgtggtgatggtcggcgccacgatggccgacgacatcgggatgggcgtgacctacctggccctcctggccgcgttcaaggtgcgccccaccttcgccgccggcctgctcctgcggaagctgacctccaaggagctcatgatgacgaccatcgggatcgtcctgctgagccagtccaccatccccgagaccgtgctcgagctgacggacgccctggccctcggcatgatggtgctgaagatcgtccgcaacatggagaagtaccagctggcggtgaccatcatggccatcctctgcgtccccaacgccgtgatcctgcagaacgcctggaaggtgagctgcaccatcctggccgtcgtgtccgtgagccccctcctgctgacctccagccagcagaagacggactggatccccctcgcgctgaccatcaaggggctgaaccccaccgccatcttcctcaccacgctgtcccgcaccaacaagaagcggagctggccgctgaacgaggccatcatggccgtcggcatggtgtccatcctcgcgagctccctgctgaagaacgacatccccatgaccggccccctcgtggccgggggcctgctgaccgtctgctacgtgctcacggggcgcagcgccgacctggagctggagcgggccaccgacgtgaagtgggaggaccaggccgagatctccggcagcagccccatcctctccatcaccatcagcgaggacgggtccatgagcatcaagaacgaggaggaggagcagaccctgacgatcctgatccgcaccggcctcctggtcatctccggcctgttcccgatcagcatccccatcaccgcggccgcctggtacctctgggaggtgaagaagcagcgggccggggtgctgtgggacgtccccagcccgccgcccatgggcaaggccgagctggaggacggggcgtaccgcatcaagcagaagggcatcctcgggtacagccagatcggcgccggcgtgtacaaggaggggaccttccacaccatgtggcacgtgacgcggggcgccgtcctgatgcacaaggggaagcgcatcgagccctcctgggccgacgtgaagaaggacctgatcagctacggcgggggctggaagctcgagggcgagtggaaggagggggaggaggtgcaggtcctggccctggagcccggcaagaacccccgggcggtgcagaccaagcccggcctcttcaagaccaacaccggcacgatcggggccgtgtccctggacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctccaccccggggcgggcaagaccaagcgctacctgcccgccatcgtgcgggaggccatcaagcgcgggctgcggaccctcatcctggccccgacccgcgtcgtggcggccgagatggaggaggccctgcggggcctccccatccgctaccagacgcccgccatccgggccgagcacaccgggcgcgagatcgtggacctgatgtgccacgcgaccttcaccatgcgcctgctcagccccgtccgggtgccgaactacaacctgatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaacacggggcacgagtgggtcaccgacttcaagggcaagaccgtgtggttcgtgccgtccatcaaggccgggaacgacatcgcggcctgcctgcggaagaacggcaagaaggtcatccagctcagccgcaagaccttcgactccgagtacgtgaagacgcggaccaacgactgggacttcgtggtcaccaccgacatcagcgagatgggcgccaacttcaaggccgagcgcgtgatcgacccccggcgctgcatgaagcccgtgatcctgacggacggggaggagcgggtcatcctggcgggccccatgccggtgacccactccagcgccgcccagcgccgggggcgcatcggccggaaccccaagaacgagaacgaccagtacatctacatgggggagcccctcgagaacgacgaggactgcgcccactggaaggaggccaagatgctgctggacaacatcaacacccccgagggcatcatcccgtccatgttcgagcccgagcgcgagaaggtggacgcgatcgacggcgagtaccggctccgcggggaggcccgcaagaccttcgtcgacctgatgcggcgcggcgacctgcccgtgtggctcgcctacaaggtggccgccgaggggatcaactacgcggaccggcgctggtgcttcgacggcatcaagaacaaccagatcctggaggagaacgtcgaggtggagatctggacgaaggagggggagcggaagaagctgaagccgcgctggctcgacgcccggatctacagcgaccccctggccctgaaggagttcaaggagttcgccgccggccgcaagtccctcaccctgaacctgatcaccgagatgggccggctccccaccttcatgacgcagaagacccgcgacgcgctggacaacctggccgtcctccacaccgccgaggccgggggccgggcgtacaaccacgccctgagcgagctgcccgagaccctcgagacgctgctgctcctgaccctgctcgccaccgtgaccgggggcatcttcctgttcctgatgtccggccgcgggatcggcaagatgaccctcgggatgtgctgcatcatcacggccagcatcctgctgtggtacgcccagatccagccgcactggatcgcggcctccatcatcctcgagttcttcctgatcgtgctgctcatccccgagcccgagaagcagcggacgccccaggacaaccagctgacctacgtcgtgatcgccatcctgaccgtggtcgccgccacgatggcgaacgagatgggcttcctcgagaagaccaagaaggacctggggctgggcagcatcgccacccagcagccggagtccaacatcctcgacatcgacctgcgccccgccagcgcctggaccctgtacgccgtggcgacgaccttcgtgacccccatgctccggcactccatcgagaacagcagcgtcaacgtgtccctgaccgccatcgccaaccaggccacggtgctgatgggcctcgggaagggctggcccctgagcaagatggacatcggggtcccgctgctcgccatcggctgctactcccaggtgaaccccatcaccctgaccgcggccctgctcctgctggtggcccactacgccatcatcgggcccggcctccaggcgaaggccacccgcgaggcccagaagcgggccgccgcgggcatcatgaagaaccccacggtcgacgggatcaccgtgatcgacctggacccgatcccctacgaccccaagttcgagaagcagctgggccaggtgatgctcctgatcctgtgcgtcacccaggtgctcatgatgcgcaccacgtgggccctgtgcgaggccctgaccctcgccaccgggcccatcagcaccctgtgggagggcaacccggggcggttctggaacacgaccatcgccgtgtccatggcgaacatcttccgcggcagctacctggccggcgccgggctcctgttctccatcatgaagaacaccaccaacacgcggcgcggcaccgggaacatcggcgagaccctgggcgagaagtggaagtcccgcctcaacgccctgggcaagagcgagttccagatctacaagaagtccgggatccaggaggtcgaccggaccctggccaaggaggggatcaagcgcggcgagacggaccaccacgcggtgtcccgggggagcgccaagctccgctggttcgtggagcggaacatggtcacccccgagggcaaggtggtggacctgggctgcgggcgcggcgggtggtcctactactgcggcgggctgaagaacgtccgggaggtgaagggcctcaccaagggcgggcccggccacgaggagcccatcccgatgagcacctacgggtggaacctggtgcgcctgcagtccggcgtcgacgtgttcttcatcccgcccgagaagtgcgacacgctcctgtgcgacatcggggagagctcccccaacccgaccgtggaggccggccggaccctgcgcgtcctcaacctggtggagaactggctgaacaacaacacccagttctgcatcaaggtgctgaacccctacatgcccagcgtcatcgagaagatggaggccctccagcggaagtacggcggggcgctggtgcgcaacccgctgtcccggaacagcacccacgagatgtactgggtgagcaacgcctccggcaacatcgtcagctccgtgaacatgatcagccgcatgctcatcaaccggttcacgatgcgccacaagaaggccacctacgagcccgacgtggacctggggtccggcacccggaacatcgggatcgagagcgagatccccaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtcaacggcgtggtgcggctcctgaccaagccgtgggacgtcctgcccacggtgacccagatggcgatgaccgacaccacgcccttcgggcagcagcgcgtgttcaaggagaaggtcgacacccgcacccaggagcccaaggagggcaccaagaagctcatgaagatcacggccgagtggctgtggaaggagctgggcaagaagaagaccccgcggatgtgcacccgcgaggagttcacccggaaggtgcgcagcaacgccgccctcggggccatcttcacggacgagaacaagtggaagtccgcgcgggaggccgtggaggacagccgcttctgggagctggtcgacaaggagcggaacctgcacctcgagggcaagtgcgagacctgcgtgtacaacatgatggggaagcgcgagaagaagctgggcgagttcgggaaggccaagggctcccgggccatctggtacatgtggctgggcgcccgcttcctcgagttcgaggcgctggggttcctgaacgaggaccactggttcagccgggagaactccctcagcggcgtcgagggggagggcctgcacaagctggggtacatcctccgcgacgtgtccaagaaggagggcggcgccatgtacgccgacgacaccgccgggtgggacacccggatcacgctggaggacctgaagaacgaggagatggtgaccaaccacatggagggcgagcacaagaagctcgcggaggccatcttcaagctgacctaccagaacaaggtcgtgcgcgtgcagcggcccacgccccgcgggaccgtcatggacatcatcagccggcgcgaccagcggggcagcggccaggtgggcacctacggcctgaacaccttcaccaacatggaggcccagctcatccgccagatggagggggagggcgtgttcaagaacatccagcacctgacggtcaccgaggaggtggccgtgcagaactggctggcccgggtcgggcgcgagcgcctctcccggatggcgatcagcggcgacgactgcgtggtgaagcccctggacgaccgcttcgccaacgccctgaccgccctcaacgacatgggcaagatccggaaggacatccagcagtgggagccgtccaaggggtggaacgactggacccaggtccccttctgcagccaccacttccacgagctgatcatgaaggacggccgcgtgctggtggtcccctgccggaaccaggacgagctcatcgggcgcgcccggatctcccagggcgcggggtggagcctgcgcgagacggcctgcctgggcaagtcctacgcccagatgtggagcctcatgtacttccaccggcgcgacctgcggctggccgccaacgcgatctgctccgccgtgcccagccactgggtgccgacctcccgcaccacctggagcatccacgccaagcacgagtggatgaccacggaggacatgctcaccgtctggaaccgggtgtggatccgcgagaacccctggatggaggacaagacccccgtggagtcctgggaggagatcccctacctgggcaagcgggaggaccagtggtgcgggagcctgatcggcctcacctcccgcgccacgtgggccaagaacatccaggcggccatcaaccaggtccggagcctgatcgggaacgaggagtacaccgactacatgccgtccatgaagcgcttccggcgcgaggaggaggaggccggcgtgctgtggtga

SEQ ID NO: 9499 - RNA, 9876 nt, synthetic construct
  misc_feature 1..9876: note = derived and/or modified CDS sequence (opt1) from DENV-2__EU482446__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcgcggtgtccttcgtgaccctgatcaccggcaacatgagcttcaaggacctcgggcgggtcgtggtgatggtcggcgccacgatggccgacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaacacggggcacgagtgggtcaccgacttcaagggcaagaccgtgtggttcgtgccgtccatcaaggccgggaacgacatcgcggcctgcctgcggaagaacggcaagaaggtcatccagctgagccgcaagaccttcgactccgagtacgtgaagacgcggaccaacgactgggacttcgtggtcaccaccgacatcagcgagatgggcgccaacttcaaggccgagcgcgtgatcgacccccggcgctgcatgaagcccgtgatcctcacggacggggaggagcgggtcatcctggcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggacgaaggagggggagcggaagaagctgaagccgcgctggctggacgcccggatctacagcgaccccctcgccctgaaggagttcaaggagttcgccgccggccgcaagtccctgaccctcaacctgatcaccgagatgggccggctgcccaccttcatgacgcagaagacccgcgacgcgctcgacaacctggccgtcctgcacaccgccgaggccgggggccgggcgtacaaccacgccctcagcgagctgcccgagaccctggagacgctcctgctgctcaccctgctggccaccgtgaccgggggcatcttcctcttcctgatgtccggccgcgggatcggcaagatgaccctggggatgtgctgcatcatcacggccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgaccgtggtcgccgccacgatggcgaacgagatgggcttcctggagaagaccaagaaggacctcgggctgggcagcatcgccacccagcagccggagtccaacatcctggacatcgacctccgccccgccagcgcctggaccctgtacgccgtggcgacgaccttcgtgacccccatgctgcggcactccatcgagaacagcagcgtcaacgtgtccctcaccgccatcgccaaccaggccacggtgctgatgggcctggggaagggctggcccctcagcaagatggacatcggggtcccgctgctggccatcggctgctactcccaggtgaaccccatcaccctcaccgcggccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggccctctgcgaggccctgaccctggccaccgggcccatcagcaccctctgggagggcaacccggggcggttctggaacacgaccatcgccgtgtccatggcgaacatcttccgcggcagctacctggccggcgccgggctcctcttctccatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtcgaccggaccctggccaaggaggggatcaagcgcggcgagacggaccaccacgcggtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgaccaagggcgggcccggccacgaggagcccatcccgatgagcacctacgggtggaacctcgtgcgcctgcagtccggcgtcgacgtgttcttcatcccgcccgagaagtgcgacacgctgctctgcgacatcggggagagctcccccaacccgaccgtggaggccggccggaccctgcgcgtcctgaacctcgtggagaactggctgaacaacaacacccagttctgcatcaaggtgctgaacccctacatgcccagcgtcatcgagaagatggaggccctgcagcggaagtacggcggggcgctcgtgcgcaacccgctgtcccggaacagcacccacgagatgtactgggtgagcaacgcctccggcaacatcgtcagctccgtgaacatgatcagccgcatgctgatcaaccggttcacgatgcgccacaagaaggccacctacgagcccgacgtggacctcgggtccggcacccggaacatcgggatcgagagcgagatccccaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtcaacggcgtggtgcggctgctcaccaagccgtgggacgtcctgcccacggtgacccagatggcgatgaccgacaccacgcccttcgggcagcagcgcgtgttcaaggagaaggtcgacacccgcacccaggagcccaaggagggcaccaagaagctgatgaagatcacggccgagtggctctggaaggagctgggcaagaagaagaccccgcggatgtgcacccgcgaggagttcacccggaaggtgcgcagcaacgccgccctgggggccatcttcacggacgagaacaagtggaagtccgcgcgggaggccgtggaggacagccgcttctgggagctcgtcgacaaggagcggaacctgcacctggagggcaagtgcgagacctgcgtgtacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtcgagggggagggcctccacaagctggggtacatcctgcgcgacgtgtccaagaaggagggcggcgccatgtacgccgacgacaccgccgggtgggacacccggatcacgctcgaggacctgaagaacgaggagatggtgaccaaccacatggagggcgagcacaagaagctggcggaggccatcttcaagctcacctaccagaacaaggtcgtgcgcgtgcagcggcccacgccccgggggacggtcatggacatcatcagccggcgcgaccagcggggcagcggccaggtggggacctacggcctgaacaccttcaccaacatggaggcccagctgatccgccagatggagggggagggcgtgttcaagaacatccagcacctcacggtcaccgaggaggtggccgtgcagaactggctggcccgggtcgggcgcgagcgcctgtcccggatggcgatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcccggatctcccagggcgcggggtggagcctccgcgagacggcctgcctgggcaagtcctacgcccagatgtggagcctgatgtacttccaccggcgcgacctccggctggccgccaacgcgatctgctccgccgtgcccagccactgggtgccgacctcccgcaccacctggagcatccacgccaagcacgagtggatgaccacggaggacatgctgaccgtctggaaccgggtgtggatccgcgagaacccctggatggaggacaagacccccgtggagtcctgggaggagatcccctacctcggcaagcgggaggaccagtggtgcgggagcctgatcggcctgacctcccgcgccacgtgggccaagaacatccaggcggccatcaaccaggtccggagcctcatcgggaacgaggagtacaccgactacatgccgtccatgaagcgcttccggcgcgaggaggaggaggccggcgtgctgtggtga

SEQ ID NO: 9500 - RNA, 9876 nt, synthetic construct
  misc_feature 1..9876: note = derived and/or modified CDS sequence (opt1) from DENV-2__EU482448__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcgcggtgtccttcgtgaccctgatcaccggcaacatgagcttcaaggacctcgggcgggtcgtggtgatggtcggcgccacgatggccgacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaacacggggcacgagtgggtcaccgacttcaagggcaagaccgtgtggttcgtgccgtccatcaaggccgggaacgacatcgcggcctgcctgcggaagaacggcaagaaggtcatccagctgagccgcaagaccttcgactccgagtacgtgaagacgcggaccaacgactgggacttcgtggtcaccaccgacatcagcgagatgggcgccaacttcaaggccgagcgcgtgatcgacccccggcgctgcatgaagcccgtgatcctcacggacggggaggagcgggtcatcctggcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggacgaaggagggggagcggaagaagctgaagccgcgctggctggacgcccggatctacagcgaccccctcgccctgaaggagttcaaggagttcgccgccggccgcaagtccctgaccctcaacctgatcaccgagatgggccggctgcccaccttcatgacgcagaagacccgcgacgcgctcgacaacctggccgtcctgcacaccgccgaggccgggggccgggcgtacaaccacgccctcagcgagctgcccgagaccctggagacgctcctgctgctcaccctgctggccaccgtgaccgggggcatcttcctcttcctgatgtccggccgcgggatcggcaagatgaccctggggatgtgctgcatcatcacggccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgaccgtggtcgccgccacgatggcgaacgagatgggcttcctggagaagaccaagaaggacctcgggctgggcagcatcgccacccagcagccggagtccaacatcctggacatcgacctccgccccgccagcgcctggaccctgtacgccgtggcgacgaccttcgtgacccccatgctgcggcactccatcgagaacagcagcgtcaacgtgtccctcaccgccatcgccaaccaggccacggtgctgatgggcctggggaagggctggcccctcagcaagatggacatcggggtcccgctgctggccatcggctgctactcccaggtgaaccccatcaccctcaccgcggccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggccctctgcgaggccctgaccctggccaccgggcccatcagcaccctctgggagggcaacccggggcggttctggaacacgaccatcgccgtgtccatggcgaacatcttccgcggcagctacctggccggcgccgggctcctcttctccatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtcgaccggaccctggccaaggaggggatcaagcgcggcgagacggaccaccacgcggtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgaccaagggcgggcccggccacgaggagcccatcccgatgagcacctacgggtggaacctcgtgcgcctgcagtccggcgtcgacgtgttcttcatcccgcccgagaagtgcgacacgctgctctgcgacatcggggagagctcccccaacccgaccgtggaggccggccggaccctgcgcgtcctgaacctcgtggagaactggctgaacaacaacacccagttctgcatcaaggtgctgaacccctacatgcccagcgtcatcgagaagatggaggccctgcagcggaagtacggcggggcgctcgtgcgcaacccgctgtcccggaacagcacccacgagatgtactgggtgagcaacgcctccggcaacatcgtcagctccgtgaacatgatcagccgcatgctgatcaaccggttcacgatgcgccacaagaaggccacctacgagcccgacgtggacctcgggtccggcacccggaacatcgggatcgagagcgagatccccaacctggacatcatcggcaagcgcatcgagaagatcaagcaggagcacgagatctcctggcactacgaccaggaccacccctacaagacctgggcctaccacggcagctacgagacgaagcagaccgggtccgccagctccatggtcaacggcgtggtgcggctgctcaccaagccgtgggacgtcctgcccaccgtgacgcagatggcgatgaccgacaccacccccttcgggcagcagcgcgtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgcagcaacgccgccctgggggccatcttcaccgacgagaacaagtggaagtccgcgcgggaggccgtggaggacagccgcttctgggagctcgtcgacaaggagcggaacctgcacctggagggcaagtgcgagacgtgcgtgtacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtcgagggggagggcctccacaagctggggtacatcctgcgcgacgtgtccaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtcgtgcgcgtgcagcggcccacgccccgggggaccgtcatggacatcatcagccggcgcgaccagcggggcagcggccaggtggggacgtacggcctgaacaccttcaccaacatggaggcccagctgatccgccagatggagggggagggcgtgttcaagaacatccagcacctcaccgtcacggaggaggtggccgtgcagaactggctggcccgggtcgggcgcgagcgcctgtcccggatggcgatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcccggatctcccagggcgcggggtggagcctccgcgagaccgcctgcctgggcaagtcctacgcccagatgtggagcctgatgtacttccaccggcgcgacctccggctggccgccaacgcgatctgctccgccgtgcccagccactgggtgccgacgtcccgcaccacctggagcatccacgccaagcacgagtggatgaccaccgaggacatgctgacggtctggaaccgggtgtggatccgcgagaacccctggatggaggacaagacccccgtggagtcctgggaggagatcccctacctcggcaagcgggaggaccagtggtgcgggagcctgatcggcctgacctcccgcgccacctgggccaagaacatccaggcggccatcaaccaggtccggagcctcatcgggaacgaggagtacacggactacatgccgtccatgaagcgcttccggcgcgaggaggaggaggccggcgtgctgtggtga

SEQ ID NO: 9501 - RNA, 9876 nt, synthetic construct
  misc_feature 1..9876: note = derived and/or modified CDS sequence (opt1) from DENV-2__EU482449__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacacgatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacgtggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcaacaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgcggagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtgttcggggccatctacggcgccgccttcagcggggtctcctggaccatgaagatcctgatcggcgcgatcatcacgtggatcgggatgaacagccgctccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccgcccgggctactacacccagacggccgggccctggcacctcggcaagctggagatggacttcgacttctgcgaggggaccaccgtcgtggtgaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtcaactccctggtgaccgcggggcacggccagatcgacaacttcagcctcggcgtgctggggatggccctgttcctcgaggagatgctgcggacccgcgtcggcaccaagcacgccatcctgctcgtggccgtgtccttcatgacgctgatcaccgggaacatgagcttccgggacctgggccgcgtcatggtgatggtgggggccaccatgaccgacgacatcggcatgggcgtcacgtacctcgcgctgctggccgccttcaaggtgcgccccaccttcgccgccgggctcctgctgcggaagctcacctccaaggagctgatgatggcgaccatcggcatcgccctgctcagccagtccacgatccccgagaccatcctggagctgaccgacgccctcgccctggggatgatggtgctgaagatcgtccgcaacatggagaagtaccagctcgccgtgaccatcatggcgatcagctgcgtgccgaacgccgtcatcctgcagaacgcctggaaggtgtcctgcacgatcctggccgcggtgagcgtcagccccctcctgctgaccagctcccagcagaaggccgactggatccccctcgccctgaccatcaagggcctgaaccccaccgccatcttcctcacgaccctgagccggacctccaagaagcgcagctggccgctgaacgaggccatcatggcggtgggcatggtgtccatcctcgccagcagcctgctgaagaacgacatccccatgaccgggcccctcgtcgccggcgggctgctgacggtgtgctacgtcctcaccggccggtccgccgacctggagctggagcgcgccaccgacgtgaagtgggaggaccaggcggagatcagcgggtccagccccatcctctccatcaccatcagcgaggacggctccatgagcatcaagaacgaggaggaggagcagacgctgaccatcctgatccggaccggcctcctggtgatctccgggctgttcccggtcagcatccccatcaccgccgccgcctggtacctctgggaggtgaagaagcagcgcgccggcgtgctgtgggacgtccccagcccgccgcccgtggggaaggcggagctggaggacggcgcctaccggatcaagcagaaggggatcctcggctacagccagatcggcgccggggtgtacaaggagggcaccttccacacgatgtggcacgtcacccgcggggccgtgctgatgcaccggggcaagcgcatcgagccctcctgggccgacgtgaagaaggacctgatcagctacgggggcggctggaagctcgagggggagtggaaggagggcgaggaggtccaggtgctggcgctggagcccgggaagaacccccgggccgtgcagaccaagcccggcctcttcaagaccaacacggggaccatcggcgccgtctccctggacttcagccccggcacctccgggagccccatcgtggaccgcaagggcaaggtggtcgggctgtacggcaacggcgtggtgacccggtccggggcctacgtcagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcggaccctcatcctggcgccgacgcgcgtggtcgccgccgagatggaggaggccctgcgcgggctccccatccggtaccagacccccgccatccgcgcggagcacaccggccgggagatcgtggacctgatgtgccacgccaccttcacgatgcgcctgctctcccccgtgcgggtcccgaactacaacctgatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagtccaacgcgcccatcatcgacgaggagcgggagatccccgagcgcagctggtccagcggccacgagtgggtgaccgacttcaaggggaagaccgtctggttcgtgccgtccatcaaggccggcaacgacatcgccgcctgcctgcggaagaacggcaagaaggtgatccagctcagccgcaagaccttcgactccgagtacgtcaagacgcggaccaacgactgggacttcgtggtgaccaccgacatcagcgagatgggggccaacttcaaggcggagcgcgtcatcgacccccggcgctgcatgaagcccgtgatcctgacggacggcgaggagcgggtgatcctggccgggcccatgccggtcacccactccagcgccgcccagcgccggggccgcatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgtccatgttcgagcccgagcgggagaaggtggacgccatcgacggggagtaccgcctccggggcgaggcccgcaagaccttcgtggacctgatgcggcgcggggacctgcccgtctggctcgcctaccgggtggccgcggagggcatcaactacgccgaccgccggtggtgcttcgacggggtgaagaacaaccagatcctggaggagaacgtcgaggtggagatctggacgaaggagggcgagcgcaagaagctgaagccgcggtggctcgacgcccgcatctacagcgaccccctggccctgaaggagttcaaggagttcgcggccggccggaagtccctcaccctgaacctgatcaccgagatggggcgcctccccaccttcatgacgcagaaggcccgggacgccctggacaacctggccgtgctccacaccgcggaggccggcgggcgcgcctacaaccacgccctgagcgagctgcccgagaccctcgagaccctgctgctcctgacgctgctcgccaccgtcaccggcggcatcttcctgttcctgatgtccgggaagggcgtggggaagatgaccctcggcatgttctgcatcatcaccgcgagcatcctgctgtggtacgcccagatccagccgcactggatcgccgccagcatcatcctcgagttcttcctgatcgtgctgctcatccccgagcccgagaagcagcggacgccccaggacaaccagctgacctacgtcgtgatcgccatcctgaccgtcgtggcggccaccatggccaacgagatggggttcctcgagaagacgaagaaggacctgggcctgggctccatcgccacccaggagccggagagcaacatcctcgacatcgacctgcgccccgcctccgcgtggaccctgtacgccgtggccaccacgttcgtcacccccatgctccggcacagcatcgagaactccagcgtgaacgtgtccctgaccgccatcgcgaaccaggccaccgtcctgatggggctcggcaaggggtggcccctgagcaagatggacatcggcgtgccgctgctcgccatcgggtgctactcccaggtgaaccccatcacgctgaccgccgccctgctcctgctgatcgcgcactacgccatcatcggccccggcctccaggccaaggccacccgcgaggcccagaagcgggcggccgccgggatcatgaagaaccccaccgtcgacggcatcacggtgatcgacctggacccgatcccctacgaccccaagttcgagaagcagctgggccaggtgatgctcctgatcctgtgcgtcacccaggtgctcatgatgcgcaccacctgggccctgtgcgaggccctgacgctcgcgaccggccccatcagcaccctgtgggaggggaacccgggccgcttctggaacaccacgatcgccgtgtccatggccaacatcttccggggcagctacctggccggggcgggcctcctgttctccatcatgaagaacaccaccaacacccgccgggggacgggcaacatcggcgagaccctgggggagaagtggaagtcccgcctcaacgccctgggcaagtccgagttccagatctacaagaagtccgggatccaggaggtcgaccggaccctggccaaggagggcatcaagcgcggggagaccgaccaccacgccgtgtcccggggcagcgccaagctccgctggttcgtggagcggaacatggtcacgcccgagggcaaggtggtggacctggggtgcggccgcgggggctggtcctactactgcgggggcctgaagaacgtccgggaggtgaagggcctcaccaagggcggccccgggcacgaggagcccatcccgatgagcacctacggctggaacctggtgcgcctgcagagcggggtcgacgtgttcttcacgccgcccgagaagtgcgacacgctcctgtgcgacatcggcgagtccagccccaacccgaccatcgaggcgggccggaccctgcgcgtgctctccctggtcgagaactggctgaacaacgacacccagttctgcatcaaggtgctcaacccctacatgcccagcgtgatcgagaagatggagaccctgcagcggaagtacgggggcgccctggtccgcaacccgctgtcccggaacagcacgcacgagatgtactgggtgtccaacgccaccgggaacatcgtgagctccgtcaacatgatcagccgcatgctcatcaaccggttcaccatgaagcacaagaaggccacctacgagcccgacgtggacctgggctccgggacgcgcaacatcggcatcgagagcgagatccccaacctggacatcatcggcaagcgcatcgagaagatcaagcaggagcacgagacctcctggcactacgaccaggaccacccctacaagacctgggcctaccacgggagctacgagaccaagcagacgggctccgcgagctccatggtgaacggggtcgtgcggctcctgaccaagccgtgggacgtggtccccatggtgacccagatggccatgaccgacacgacccccttcggccagcagcgcgtgttcaaggagaaggtcgacacccggacccaggagcccaaggagggcacgaagaagctgatgaagatcaccgccgagtggctctggaaggagctggggaagaagaagaccccgcgcatgtgcacccgggaggagttcacgcgcaaggtgcggagcaacgccgccctgggcgcgatcttcaccgacgagaacaagtggaagtccgcccgcgaggccgtggaggacagccggttctgggagctcgtcgacaaggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttctcccgcgagaacagcctgtccggggtggagggcgaggggctccacaagctgggctacatcctgcgggacgtcagcaagaaggagggcggggccatgtacgccgacgacaccgcgggctgggacacgcgcatcaccctcgaggacctgaagaacgaggagatggtgaccaaccacatggagggggagcacaagcggctggccgaggccatcttcaagctcacctaccagaacaaggtggtccgcgtgcagcggcccacgccccgcggcaccgtcatggacatcatctcccggcgcgaccagcgcgggagcggccaggtgggcacctacgggctgaacaccttcacgaacatggaggcccagctgatccggcagatggagggcgaggggatcttcaagtccatccagcacctcaccgtgaccgaggagatcgccgtccagaactggctggcgcgcgtgggccgggagcgcctgagccggatggccatctccggcgacgactgcgtggtcaagcccctcgacgaccgcttcgccagcgccctgaccgccctgaacgacatggggaaggtgcggaaggacatccagcagtgggagccgtccaagggctggaacgactggacccaggtgcccttctgcagccaccacttccacgagctcatcatgaaggacgggcgcgtcctggtggtgccctgccggaaccaggacgagctgatcggccgcgcgcggatctcccagggggccggctggagcctcaaggagaccgcctgcctgggcaagtcctacgcccagatgtggagcctgatgtacttccaccgccgggacctccgcctggccgcgaacgccatctgctccgccgtccccagccactgggtgccgaccagccggaccacctggtccatccacgccaagcacgagtggatgacgaccgaggacatgctgaccgtgtggaaccgcgtctggatccaggagaacccctggatggaggacaagacccccgtggagagctgggaggaggtgccctacctcgggaagcgggaggaccagtggtgcggctccctgatcgggctgacgagccgcgcgacctgggccaagaacatccagaccgccatcaaccaggtccggtccctcatcggcaacgaggagtacaccgactacatgccgagcatgaagcgcttccgccgggaggaggaggaggccggggtgctgtggtga

SEQ ID NO: 9502 - RNA, 9876 nt, synthetic construct
  misc_feature 1..9876: note = derived and/or modified CDS sequence (opt1) from DENV-2__EU482450__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtggtcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatgacggacgacatcgggatgggcgtgacctacctggccctgctcgccgcgttcaaggtccgccccaccttcgccgccggcctgctgctccggaagctgacctccaaggagctgatgatgacgaccatcgggatcgtgctcctgagccagtccgccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggcggggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtcacgcccatgctgcggcacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgcgaggcccagaagcgggccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatctccaccctctgggagggcaacccggggcggttctggaacaccaccatcgcggtcagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtggtccggctgctcaccaagccgtgggacgtgctgcccaccgtgacccagatggccatgacggacaccacccccttcgggcagcagcgcgtcttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtcgaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtgagcaagaaggagggcggcgccatgtacgccgacgacacggcggggtgggacacccggatcaccctcgaggacctgaagaacgaggagatggtcaccaaccacatggagggcgagcacaagaagctggccgaggccatcttcaagctcacgtaccagaacaaggtggtgcgcgtccagcggcccacgccccgggggaccgtgatggacatcatcagccggcgcgaccagcggggctccggccaggtggggacctacggcctgaacacgttcaccaacatggaggcccagctgatccgccagatggagggggagggcgtcttcaagaacatccagcacctcaccgtgaccgaggaggtggccgtcaagaactggctggcgcgggtggggcgcgagcgcctgagccggatggccatctccggcgacgactgcgtggtcaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtcccgaccagccgcacgacctggtccatccacgccaagcacgagtggatgaccaccgaggacatgctgaccgtgtggaaccgggtgtggatccgcgagaacccctggatggaggacaagacgcccgtcgagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacgccgactacatgccgagcatgaagcgcttccggcgcgaggaggaggaggcgggcgtgctgtggtga

SEQ ID NO: 9503 - RNA, 9876 nt, synthetic construct
  misc_feature 1..9876: note = derived and/or modified CDS sequence (opt1) from DENV-2__EU569721__SS-prME
  source 1..9876: mol_type = other RNA
agcgcggggatgatcatcatgctgatccccaccgtgatggccttccacctcaccacccggaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagccccctgccgatgggcaaggcggagctggaggacggggcctaccgcatcaagcagaagggcatcctcgggtacagccagatcggcgccggcgtgtacaaggaggggaccttccacaccatgtggcacgtgacccggggcgccgtcctgatgcacaaggggaagcgcatcgagccctcctgggccgacgtgaagaaggacctgatcagctacggcgggggctggaagctcgagggcgagtggaaggagggggaggaggtgcaggtcctggcgctggagcccggcaagaacccgcgggccgtgcagacgaagcccggcctcttcaagaccaacaccggcaccatcggggccgtgtccctggacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaacccggagatcgaggacgacatcttccggaagaagcgcctgaccatcatggacctccaccccggggccggcaagacgaagcggtacctgcccgccatcgtgcgcgaggccatcaagcgggggctgcgcaccctcatcctggcgcccacccgggtcgtggccgccgagatggaggaggccctgcgcggcctcccgatccggtaccagacccccgccatccgcgcggagcacacggggcgggagatcgtggacctgatgtgccacgccaccttcaccatgcgcctgctcagccccgtccgcgtgcccaactacaacctgatcatcatggacgaggcccacttcaccgacccggcctccatcgccgcgcggggctacatcagcacgcgcgtggagatgggcgaggccgccgggatcttcatgaccgccacgccgcccggcagccgggaccccttcccgcagtccaacgcccccatcatcgacgaggagcgcgagatccccgagcggagctggaactccgggcacgagtgggtcaccgacttcaagggcaagacggtgtggttcgtgcccagcatcaaggcggggaacgacatcgccgcctgcctgcgcaagaacggcaagaaggtcatccagctctcccggaagaccttcgacagcgagtacgtgaagacccgcaccaacgactgggacttcgtggtcacgaccgacatctccgagatgggcgccaacttcaaggcggagcgggtgatcgacccgcgccggtgcatgaagcccgtgatcctgaccgacggggaggagcgcgtcatcctggccggccccatgcccgtgacccacagctccgccgcccagcggcgcgggcggatcggccgcaacccgaagaacgagaacgaccagtacatctacatgggggagcccctcgagaacgacgaggactgcgcccactggaaggaggcgaagatgctgctggacaacatcaacacgcccgagggcatcatccccagcatgttcgagccggagcgggagaaggtggacgccatcgacggcgagtaccgcctccgcggggaggcccgcaagaccttcgtcgacctgatgcgccggggcgacctgcccgtgtggctcgcctacaaggtggccgcggaggggatcaactacgccgaccgccggtggtgcttcgacggcatcaagaacaaccagatcctggaggagaacgtcgaggtggagatctggaccaaggagggggagcgcaagaagctgaagccccggtggctcgacgcccgcatctactccgacccgctggccctgaaggagttcaaggagttcgccgcgggccggaagtccctcaccctgaacctgatcacggagatgggccgcctccccaccttcatgacccagaagacccgggacgccctggacaacctggccgtcctccacacggccgaggccggcgggcgcgcctacaaccacgccctgtccgagctgcccgagaccctcgagaccctgctgctcctgaccctgctcgccacggtgaccgggggcatcttcctgttcctgatgagcggccgggggatcggcaagatgaccctcgggatgtgctgcatcatcaccgcctccatcctgctgtggtacgcgcagatccagccccactggatcgccgccagcatcatcctcgagttcttcctgatcgtgctgctcatcccggagcccgagaagcagcgcacgccccaggacaaccagctgacgtacgtcgtgatcgccatcctgaccgtggtcgccgcgaccatggccaacgagatgggcttcctcgagaagaccaagaaggacctggggctgggctccatcgccacgcagcagcccgagagcaacatcctcgacatcgacctgcggccggcctccgcctggaccctgtacgcggtggccaccaccttcgtgacgcccatgctccgccacagcatcgagaacagctccgtcaacgtgagcctgaccgccatcgccaaccaggccaccgtgctgatgggcctcgggaagggctggcccctgtccaagatggacatcggggtccccctgctcgcgatcggctgctacagccaggtgaacccgatcaccctgacggccgccctgctcctgctggtggcccactacgcgatcatcgggcccggcctccaggccaaggccacccgggaggcccagaagcgcgccgcggccggcatcatgaagaaccccaccgtcgacgggatcaccgtgatcgacctggaccccatcccgtacgaccccaagttcgagaagcagctgggccaggtgatgctcctgatcctgtgcgtcacccaggtgctcatgatgcggaccacctgggccctgtgcgaggccctgaccctcgccacggggcccatctccaccctgtgggagggcaaccccgggcgcttctggaacaccaccatcgcggtgagcatggccaacatcttccggggctcctacctggccggcgccgggctcctgttcagcatcatgaagaacacgaccaacacccgccggggcaccgggaacatgggcgagacgctgggcgagaagtggaagtcccgcctcaacgccctgggcaagagcgagttccagatctacaagaagtccggcatccaggaggtcgaccgcaccctggcgaaggaggggatcaagcggggcgagaccgaccaccacgccgtgagccgcgggtccgccaagctccggtggttcgtggagcgcaacatggtcaccccggagggcaaggtggtggacctgggctgcgggcggggcgggtggagctactactgcggcgggctgaagaacgtccgcgaggtgaagggcctcacgaagggcgggcccggccacgaggagcccatccccatgtccacctacgggtggaacctggtgcggctgcagagcggcgtcgacgtgttcttcatcccgcccgagaagtgcgacaccctcctgtgcgacatcggggagtccagccccaaccccaccgtggaggccggccgcacgctgcgggtcctcaacctggtggagaactggctgaacaacaacacccagttctgcatcaaggtgctgaacccgtacatgccctccgtcatcgagaagatggaggcgctccagcgcaagtacggcggggccctggtgcggaaccccctgagccgcaacagcacccacgagatgtactgggtgtccaacgccagcggcaacatcgtctccagcgtgaacatgatctcccggatgctcatcaaccgcttcaccatgcggcacaagaaggccacctacgagccggacgtggacctggggagcggcacgcgcaacatcgggatcgagtccgagacccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtcaacggcgtggtgcgcctcctgaccaagccctgggacgtcctgccgaccgtgacgcagatggccatgaccgacaccacccccttcgggcagcagcgggtgttcaaggagaaggtcgacacgcgcacccaggagcccaaggagggcaccaagaagctcatgaagatcaccgccgagtggctgtggaaggagctgggcaagaagaagacgccccgcatgtgcacccgggaggagttcacccgcaaggtgcggtccaacgccgccctcggggcgatcttcaccgacgagaacaagtggaagtccgcccgcgaggccgtggaggactcccggttctgggagctggtcgacaaggagcgcaacctgcacctcgagggcaagtgcgagacgtgcgtgtacaacatgatggggaagcgggagaagaagctgggcgagttcgggaaggccaagggcagccgcgccatctggtacatgtggctgggcgcgcggttcctcgagttcgaggccctggggttcctgaacgaggaccactggttctcccgcgagaacagcctctccggcgtcgagggggagggcctgcacaagctggggtacatcctccgggacgtgagcaagaaggagggcggcgccatgtacgccgacgacaccgcggggtgggacacccgcatcaccctggaggacctgaagaacgaggagatggtgacgaaccacatggagggcgagcacaagaagctcgccgaggccatcttcaagctgacctaccagaacaaggtcgtgcgggtgcagcgcccgacgccccgggggaccgtcatggacatcatcagccgccgggaccagcgcggctccggccaggtggggacgtacggcctgaacaccttcaccaacatggaggcccagctcatccggcagatggagggggagggcgtgttcaagaacatccagcacctgaccgtcacggaggaggtggccgtgcagaactggctggcgcgcgtcgggcgggagcgcctcagccgcatggccatctccggcgacgactgcgtggtgaagcccctggacgaccggttcgccaacgccctgaccgccctcaacgacatgggcaagatccgcaaggacatccagcagtgggagcccagcaaggggtggaacgactggacccaggtcccgttctgctcccaccacttccacgagctgatcatgaaggacggccgggtgctggtggtcccctgccgcaaccaggacgagctcatcgggcgggcgcgcatcagccagggcgccgggtggtccctgcgggagaccgcctgcctgggcaagagctacgcccagatgtggtccctcatgtacttccaccgccgggacctgcgcctggccgcgaacgccatctgcagcgccgtgccctcccactgggtgcccacgagccggaccacctggtccatccacgccaagcacgagtggatgaccaccgaggacatgctcacggtctggaaccgcgtgtggatccgggagaacccgtggatggaggacaagacccccgtggagagctgggaggagatcccctacctgggcaagcgcgaggaccagtggtgcgggtccctgatcggcctcaccagccgggccacctgggcgaagaacatccaggccgccatcaaccaggtccgctccctgatcgggaacgaggagtacacggactacatgcccagcatgaagcggttccgccgggaggaggaggaggccggcgtgctgtggtga

SEQ ID NO: 9504 - RNA, 9876 nt, synthetic construct
  misc_feature 1..9876: note = derived and/or modified CDS sequence (opt1) from DENV-2__EU482451__SS-prME
  source 1..9876: mol_type = other RNA
agcgccggcatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcggagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgggtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcgggctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccggggccgagctgaccggctacggcaccgtcacgatggagtgcagcccccggaccgggctcgacttcaacgagatggtgctgctgcagatggagaacaaggcctggctcgtgcaccgccagtggttcctggacctgcccctcccctggctgccgggcgccgacaagcaggagtccaactggatccagaaggagaccctggtcaccttcaagaacccccacgccaagaagcaggacgtggtcgtgctcgggagccaggagggcgcgatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtggtcaaggagatcgccgagacccagcacgggaccatcgtgatccgggtgcagtacgagggcgacggcagcccctgcaagatccccttcgagatcatggacctggagaagcgctacgtcctcgggcggctgatcaccgtgaacccgatcgtgacggagaaggactcccccgtcaacatcgaggccgagccgcccttcggcgacagctacatcatcatcggggtggagccgggccagctgaagctcaactggttcaagaaggggtccagcatcggccagatgttcgagaccaccatgcgcggcgcgaagcgcatggccatcctgggggacaccgcctgggacttcggctccctcggcggggtgttcacgagcatcgggaaggccctccaccaggtcttcggggccatctacggcgcggccttctccggggtgagctggaccatgaagatcctgatcggcgtgatcatcacctggatcgggatgaactcccggagcacctccctgagcgtctccctggtgctcgtgggcatcgtcacgctgtacctgggggtgatggtgcaggccgacagcggctgcgtcgtgtcctggaagaacaaggagctcaagtgcggcagcgggatcttcgtgaccgacaacgtccacacctggaccgagcagtacaagttccagcccgagagcccctccaagctggccagcgcgatccagaaggcccaggaggagggcatctgcgggatccgctccgtgacgcggctggagaacctcatgtggaagcagatcacccccgagctgaaccacatcctggccgagaacgaggtgaagctcaccatcatgaccggcgacatcaaggggatcatgcaggccggcaagcgcagcctgcggccgcagcccacggagctgaagtactcctggaagacctggggcaaggccaagatgctcagcaccgagtcctacaaccagaccttcctgatcgacgggcccgagacggcggagtgcccgaacaccaaccgcgcctggaacagcctggaggtcgaggactacggcttcggggtgttcaccaccaacatctggctcaagctgaaggagaagcaggacgccttctgcgactccaagctgatgagcgccgccatcaaggacaaccgggcggtgcacgccgacatgggctactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccgggcccgtgagccagcacaactaccgcccgggctaccacacccagatcgcggggccctggcacctgggcaagctggagatggacttcgacttctgcgacgggaccaccgtcatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtgaactccctcgtcaccgccgggcacggccaggtggacaacttcagcctgggcgtgctggggatggccctcttcctggaggagatgctgcggacccgcgtcggcacgaagcacgcgatcctcctggtggccgtgtccttcgtcaccctgatcaccgggaacatgagcttcaaggacctcggccgggtggtggtcatggtgggggccaccatggccgacgacatcggcatgggcgtgacgtacctggccctgctcgcggccttcaaggtccgccccaccttcgccgccgggctgctgctccggaagctgacctccaaggagctgatgatgaccacgatcggcatcgtgctcctgagccagtccaccatccccgagaccgtgctggagctcaccgacgccctggcgctggggatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaagggcctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccgggcccctggtcgccggcgggctcctgaccgtgtgctacgtgctgaccggccgcagcgccgacctcgagctggagcgggccacggacgtcaagtgggaggaccaggcggagatctccgggagcagccccatcctgtccatcaccatcagcgaggacggctccatgagcatcaagaacgaggaggaggagcagaccctcaccatcctgatccgcacgggcctgctcgtgatctccgggctgttcccgatcagcatccccatcaccgccgccgcctggtacctgtgggaggtgaagaagcagcgggccggcgtcctctgggacgtgcccagcccgccgcccatggggaaggcggagctggaggacggcgcctaccgcatcaagcagaaggggatcctgggctacagccagatcggcgccggggtgtacaaggagggcaccttccacaccatgtggcacgtcacccgcggggccgtgctcatgcacaagggcaagcgcatcgagccctcctgggccgacgtgaagaaggacctgatcagctacgggggcggctggaagctggagggggagtggaaggagggcgaggaggtccaggtgctcgcgctggagcccgggaagaacccccgggccgtgcagacgaagcccggcctgttcaagacctccaccgggaccatcggcgccgtcagcctcgacttctcccccggcacgagcgggtcccccatcatcgacaagaagggcaaggtggtggggctgtacggcaacggcgtcgtgacccgcagcggggcctacgtgtccgccatcgcgcagaccgagaagtccatcgaggacaaccccgagatcgaggacgacatcttccggaagcgccggctgaccatcatggacctgcaccccggcgccgggaagacgaagcgctacctccccgccatcgtccgggaggccatcaagcgcggcctgcggaccctgatcctcgcgccgacccgcgtggtggccgccgagatggaggaggccctgcgggggctgcccatccgctaccagacccccgccatccgggcggagcacacgggccgcgagatcgtcgacctcatgtgccacgccaccttcaccatgcgcctgctgtcccccgtgcgggtgccgaactacaacctcatcatcatggacgaggcccacttcaccgaccccgccagcatcgccgcgcgcggctacatcagcacgcgggtcgagatgggggaggccgccggcatcttcatgaccgccacgccgcccgggtcccgcgacccgttcccccagagcaacgcccccatcatcgacgaggagcgggagatccccgagcgctcctggaacagcggccacgagtgggtgaccgacttcaaggggaagacggtgtggttcgtcccgtccatcaaggcgggcaacgacatcgccgcctgcctgcggaagaacggcaagaaggtgatccagctgagccgcaagaccttcgactccgagtacgtgaagaccaagaccaacgactgggacttcgtcgtgacgaccgacatcagcgagatgggggccaacttcaaggcggagcgggtgatcgacccccgccggtgcatgaagcccgtcatcctcaccgacggcgaggagcgcgtgatcctggccgggcccatgccggtgacccactccagcgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacgcccgagggcatcatcccgtccatgttcgagcccgagcgggagaaggtcgacgccatcgacggggagtaccgcctgcggggcgaggcccgcaagaccttcgtggacctcatgcgccgcggggacctgcccgtgtggctggcctacaaggtcgccgcggagggcatcaactacgccgaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaagacccgggacgccctcgacaacctggccgtgctgcacacggccgaggcgggcgggcgcgcctacaaccacgccctcagcgagctgcccgagaccctggagaccctcctgctgctcaccctgctggccacggtgaccggcggcatcttcctcttcctgatgtccgggcggggcatcgggaagatgaccctgggcatgtgctgcatcatcaccgccagcatcctcctgtggtacgcgcagatccagccgcactggatcgccgcctccatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatggggttcctggagaagaccaagaaggacctcggcctgggcagcatcgccacgcagcagccggagtccaacatcctggacatcgacctccggcccgccagcgcctggaccctgtacgcggtggccaccaccttcgtcacgcccatgctgcgccacagcatcgagaactccagcgtgaacgtgtccctcaccgccatcgccaaccaggccaccgtcctgatggggctgggcaaggggtggcccctcagcaagatggacatcggcgtgccgctgctggcgatcgggtgctactcccaggtgaaccccatcaccctcacggccgccctgctgctcctggtcgcccactacgcgatcatcggccccggcctgcaggccaaggccacccgggaggcccagaagcgcgccgcggccgggatcatgaagaaccccaccgtggacggcatcaccgtgatcgacctcgacccgatcccctacgaccccaagttcgagaagcagctggggcaggtcatgctgctcatcctgtgcgtgacccaggtgctgatgatgcggaccacctgggccctctgcgaggccctgaccctggccacgggccccatcagcaccctctgggaggggaacccgggccgcttctggaacaccaccatcgcggtctccatggccaacatcttccggggcagctacctggccggggccggcctcctgttctccatcatgaagaacacgaccaacacccgccgggggaccggcaacatcggcgagacgctgggggagaagtggaagtcccgcctgaacgccctcggcaagtccgagttccagacctacaagaagtccgggatccaggaggtggaccgcaccctggcgaaggagggcatcaagcgcggggagaccgaccaccacgccgtgtcccgcggcagcgccaagctgcggtggttcgtcgagcgcaacatggtgacgcccgagggcaaggtggtcgacctcgggtgcggccgcgggggctggtcctactactgcgggggcctgaagaacgtgcgcgaggtgaagggcctgaccaagggcggccccgggcacgaggagcccatcccgatgagcacctacggctggaacctcgtccggctgcagtccggggtggacgtgttcttcatcccgcccgagaagtgcgacaccctgctctgcgacatcggcgagagctcccccaacccgacggtcgaggccggccgcaccctgcgggtgctgaacctcgtggagaactggctgaacaacaacacccagttctgcatcaaggtcctgaacccctacatgcccagcgtgatcgagaagatggaggcgctgcagcgcaagtacgggggcgccctcgtgcggaacccgctgagccgcaactccacccacgagatgtactgggtcagcaacgcctccgggaacatcgtgagctccgtgaacatgatcagccggatgctgatcaaccgcttcaccatgcggcacaagaaggccacgtacgagcccgacgtcgacctcggctccgggacccgcaacatcggcaacgagagcgagatccccaacctggacatcatcggcaagcggatcgagaagatcaagcaggagcacgagacctcctggcactacgaccaggaccacccctacaagacctgggcctaccacgggagctacgagacgaagcagaccggctccgcgagctccatggtgaacggggtggtccgcctgctcaccaagccgtgggacgtgctgcccaccgtgacgcagatggccatgaccgacaccacccccttcggccagcagcgggtcttcaaggagaaggtggacacgcgcacccaggagcccaaggagggcaccaagaagctgatgaagatcaccgccgagtggctctggaaggagctggggaagaagaagacgccgcgcatgtgcacccgggaggagttcacccgcaaggtgcggagcaacgccgccctgggcgcgatcttcaccgacgagaacaagtggaagtccgcccgcgaggccgtcgaggacagccggttctgggagctcgtggacaaggagcgcaacctgcacctggaggggaagtgcgagacgtgcgtctacaacatgatgggcaagcgggagaagaagctcggggagttcggcaaggccaagggctcccgcgccatctggtacatgtggctgggggcgcggttcctggagttcgaggccctcggcttcctgaacgaggaccactggttcagccgcgagaactccctgagcggggtggagggcgaggggctccacaagctgggctacatcctgcgggacgtgagcaagaaggagggcggggccatgtacgccgacgacaccgcgggctgggacacccgcatcaccctcgaggacctgaagaacgaggagatggtcacgaaccacatggagggggagcacaagaagctggccgaggccatcttcaagctcacctaccagaacaaggtggtgcgggtccagcgccccacgccccggggcaccgtgatggacatcatctcccgccgggaccagcgcgggagcggccaggtgggcacgtacgggctgaacaccttcaccaacatggaggcccagctgatccggcagatggagggcgagggggtcttcaagaacatccagcacctcaccgtgacggaggaggtggccgtccagaactggctggcgcgcgtgggccgggagcgcctgtcccgcatggccatcagcggcgacgactgcgtggtcaagcccctcgacgaccggttcgccaacgccctgaccgccctgaacgacatggggaagatccgcaaggacatccagcagtgggagccgtccaagggctggaacgactggacccaggtgcccttctgcagccaccacttccacgagctcatcatgaaggacgggcgggtgctggtcgtgccctgccgcaaccaggacgagctgatcggccgggcgcgcatctcccagggggccggctggagcctccgggagaccgcctgcctgggcaagtcctacgcccagatgtggagcctgatgtacttccaccgccgggacctccgcctggccgcgaacgccatctgctccgccgtgcccagccactgggtcccgacgtcccggaccacctggagcatccacgccaagcacgagtggatgaccaccgaggacatgctgacggtgtggaaccgcgtgtggatccgggagaacccctggatggaggacaagacccccgtcgagtcctgggaggagatcccctacctcgggaagcgcgaggaccagtggtgcggcagcctgatcgggctgacctcccgggccacctgggcgaagaacatccaggtggccatcaaccaggtgcgcagcctcatcggcaacgaggagtacacggactacatgccgagcatgaagcggttccgccgggaggaggaggaggccggggtcctgtggtga

SEQ ID NO: 9505 - RNA, 9876 nt, synthetic construct
  misc_feature 1..9876: note = derived and/or modified CDS sequence (opt1) from DENV-2__EU660413__SS-prME
  source 1..9876: mol_type = other RNA
agcgcgggcatgatcatcatgctgatccccaccgtgatggccttccacctcaccacccggaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcggagcgtggccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctcttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcttcgacttcaacgagatggtgctcctgcagatggagaacaaggcctggctggtgcaccgccagtggttcctcgacctgcccctgccctggctcccgggggccgacaagcaggagtccaactggatccagaaggagaccctggtcaccttcaagaacccccacgccaagaagcaggacgtggtcatcctgggcagccaggagggggcgatgcacacggccctcaccggcgccaccgagatccagatgagctccgggaacctgctgttcaccggccacctcaagtgccggctgcgcatggacaagctgcagctcaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctgggccggctcatcaccgtcaacccgatcgtgacggagaaggactcccccgtgaacatcgaggccgagccgcccttcggggacagctacatcatcatcggcgtcgagccggggcagctgaagctgaactggttcaagaagggctccagcatcgggcagatgttcgagaccaccatgcgcggcgcgaagcgcatggccatcctcggcgacaccgcctgggacttcgggtccctgggcggggtgttcacgagcatcggcaaggccctgcaccaggtgttcggggccatctacggcgcggccttctccggcgtcagctggaccatgaagatcctcatcggggtgatcatcacctggatcggcatgaactcccggagcacctccctgagcgtgtccctggtcctggtggggatcgtgacgctctacctgggcgtcatggtgcaggccgacagcgggtgcgtggtctcctggaagaacaaggagctgaagtgcggcagcggcatcttcatcaccgacaacgtgcacacctggaccgagcagtacaagttccagcccgagagcccctccaagctcgccagcgcgatccagaaggcccaggaggaggggatctgcggcatccgctccgtgacgcggctggagaacctgatgtggaagcagatcacccccgagctcaaccacatcctggccgagaacgaggtcaagctgaccatcatgaccggggacatccgcggcatcatgcaggccgggaagcggagcctccgcccgcagcccacggagctgaagtactcctggaagacctggggcaaggccaagatgctgagcaccgagtcctacaaccagaccttcctcatcgacggccccgagacggcggagtgcccgaacaccaaccgggcctggaacagcctggaggtggaggactacgggttcggcgtgttcaccaccaacatctggctgaagctcaaggagaagcaggacgccttctgcgactccaagctgatgagcgccgccatcaaggacaaccgcgcggtccacgccgacatggggtactggatcgagtccgccctgaacgacacgtggaagatcgagaaggccagcttcatcgaggtgaagaactgccactggcccaagtcccacaccctctggagcaacggcgtgctggagtccgagatgatcatccccaagaacctggccggccccgtcagccagcacaactaccggccggggtaccacacccagatcgcgggcccctggcacctcgggaagctggagatggacttcgacttctgcgacggcaccaccgtgatcgtgacggaggactgcgggaaccgcggcccctccctgcggaccaccaccgccagcggcaagctcatcacggagtggtgctgccgcagctgcaccctgcccccgctgcggtaccgcggggaggacggctgctggtacgggatggagatccggcccctcaaggagaaggaggagaacctggtcaactccctggtgaccgccggccacggccaggtggacaacttcagcctcggcgtcctgggcatggccctgttcctcgaggagatgctgcgcacccgggtggggacgaagcacgcgatcctgctcgtggccgtctccttcgtgaccctgatcaccggcaacatgagcttcaaggacctggggcgcgtggtcgtgatggtgggcgccaccatggccgacgacatcgggatgggcgtcacgtacctcgccctgctggcggccttcaaggtgcggcccaccttcgccgccggcctcctgctgcgcaagctcacctccaaggagctgatgatgaccacgatcgggatcgtgctgctcagccagtccaccatccccgagaccgtcctggagctgaccgacgccctcgcgctgggcatgatggtgctgaagatcgtgcgcaacatggagaagtaccagctcgccgtcacgatcatggccatcctgtgcgtgccgaacgccgtcatcctgcagaacgcctggaaggtgagctgcaccatcctcgcggtggtctccgtgagccccctgctgctcacctccagccagcagaagaccgactggatccccctggccctgacgatcaaggggctctcccccaccgccatcttcctgaccaccctgagccggtccaacaagaagcgcagctggccgctcaacgaggccatcatggcggtgggcatggtctccatcctggccagctccctgctcaagaacgacatccccatgacgggccccctggtggccgggggcctgctcaccgtgtgctacgtcctgaccgggcggagcgccgacctggagctcgagcgcgccaccgacgtgaagtgggaggaccaggcggagatcagcggctccagccccatcctgtccatcacgatcagcgaggacgggtccatgagcatcaagaacgaggaggaggagcagaccctgaccatcctcatccggaccggcctgctggtgatctccggcctcttcccgatcagcatccccatcacggccgccgcctggtacctgtgggaggtcaagaagcagcgcgccggggtgctgtgggacgtgcccagcccgccgcccatgggcaaggcggagctcgaggacggggcctaccggatcaagcagaagggcatcctggggtacagccagatcggcgccggcgtctacaaggaggggaccttccacaccatgtggcacgtgacccgcggcgccgtgctgatgcacaaggggaagcggatcgagccctcctgggccgacgtcaagaaggacctcatcagctacggcgggggctggaagctggagggcgagtggaaggagggggaggaggtccaggtgctggcgctcgagcccggcaagaacccccgcgccgtccagaccaagcccgggctgttcaagacgaacaccggcaccatcggggccgtgtccctggacttcagccccggcacctccggcagccccatcatcgacaagaaggggaaggtggtcggcctctacgggaacggcgtggtgacgcggtccggcgcctacgtcagcgccatcgcgcagaccgagaagtccatcgaggacaaccccgagatcgaggacgacatcttccgcaagcggcgcctgaccatcatggacctgcaccccggggccggcaagaccaagcggtacctgcccgccatcgtgcgcgaggccatcaagcgggggctccgcacgctgatcctggcgccgacccgggtggtcgccgccgagatggaggaggccctccgcggcctgcccatccggtaccagacccccgccatccgcgcggagcacaccgggcgcgagatcgtggacctgatgtgccacgccacgttcaccatgcggctcctgagccccgtgcgcgtcccgaactacaacctgatcatcatggacgaggcccacttcaccgaccccgccagcatcgccgcgcggggctacatctccacccgcgtggagatgggcgaggccgccgggatcttcatgacggccacgccgcccggcagccgggacccgttcccccagtccaacgcccccatcatcgacgaggagcgcgagatccccgagcggagctggaactccgggcacgagtgggtgaccgacttcaagggcaagaccgtctggttcgtgccgagcatcaaggcggggaacgacatcgccgcctgcctccgcaagaacggcaagaaggtgatccagctgtcccggaagacgttcgacagcgagtacgtcaagacccgcaccaacgactgggacttcgtggtgaccacggacatctccgagatgggcgccaacttcaaggcggagcgggtcatcgacccccgccggtgcatgaagcccgtgatcctgaccgacggggaggagcgcgtgatcctcgccggccccatgccggtcacccacagctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccggaagacgttcgtggacctgatgcgccggggcgacctccccgtctggctggcctacaaggtggccgcggaggggatcaactacgccgaccgccggtggtgcttcgacggcatcaagaacaaccagatcctggaggagaacgtggaggtcgagatctggaccaaggagggggagcgcaagaagctcaagccgcggtggctggacgcccgcatctactccgaccccctggccctcaaggagttcaaggagttcgccgcgggccggaagtccctgaccctgaacctcatcaccgagatgggccgcctgcccacgttcatgacccagaagacccgggacgccctggacaacctcgccgtgctgcacaccgccgaggccggcgggcgcgcctacaaccacgccctgtccgagctccccgagacgctggagaccctgctcctgctgaccctcctggccaccgtcaccggcgggatcttcctgttcctcatgagcgggcgggggatcgggaagatgaccctggggatgtgctgcatcatcaccgcctccatcctgctctggtacgcgcagatccagccgcactggatcgccgccagcatcatcctggagttcttcctgatcgtgctcctgatccccgagcccgagaagcagcgcacgccccaggacaaccagctgacctacgtggtcatcgccatcctcacggtggtggccgcgaccatggccaacgagatgggcttcctggagaagaccaagaaggacctggggctcggcggcatcgccacccagcagccggagtccaacatcctggacatcgacctgcggcccgccagcgcctggacgctctacgcggtcgccaccaccttcgtgacccccatgctgcgccacagcatcgagaactccagcgtgaacgtctccctgacggccatcgccaaccaggccaccgtgctcatggggctgggcaaggggtggcccctgagcaagatggacatcggcgtgccgctcctggcgatcgggtgctactcccaggtcaaccccatcaccctgaccgccgccctcctgctgctcgtggcccactacgcgatcatcggccccggcctgcaggccaaggccacgcgggaggcccagaagcgcgccgcggccgggatcatgaagaaccccaccgtggacggcatcaccgtcatcgacctggacccgatcccctacgaccccaagttcgagaagcagctcggccaggtgatgctgctgatcctctgcgtgacccaggtcctgatgatgcggacgacctgggccctgtgcgaggccctcaccctggccaccggccccatcagcacgctgtgggaggggaacccgggccgcttctggaacaccaccatcgcggtgtccatggccaacatcttccggggcagctacctcgccggggccggcctgctgttctccatcatgaagaacaccacgaacacccgccgcgggaccggcaacatcggcgagaccctcggggagaagtggaagtcccggctgaacgccctgggcaagtccgagttccagatctacaagaagtccgggatccaggaggtggaccgcacgctcgcgaaggagggcatcaagcgcggggagaccgaccaccacgccgtctcccgcggcagcgccaagctgcggtggttcgtggagcgcaacatggtgacccccgagggcaaggtcgtggacctggggtgcggccgcggcgggtggtcctactactgcggcgggctcaagaacgtgcgcgaggtcaaggggctgaccaagggcgggcccgggcacgaggagcccatcccgatgagcacgtacggctggaacctggtgcggctccagtccggggtggacgtcttcttcatcccgcccgagaagtgcgacaccctgctgtgcgacatcggcgagagctcccccaacccgaccgtggaggccggccgcaccctccgggtgctgaacctggtcgagaactggctcaacaacaacacgcagttctgcatcaaggtgctgaacccctacatgcccagcgtgatcgagaagatggaggcgctgcagcgcaagtacgggggcgccctggtccggaacccgctcagccgcaactccacccacgagatgtactgggtgagcaacgcctccgggaacatcgtgagctccgtcaacatgatcagccggatgctgatcaaccgcttcaccatgcggcacaagaaggccacctacgagcccgacgtggacctgggctccgggacccgcaacatcggcatcgagagcgagaagcccaacctcgacatcatcggcaagcggatcgagaagatcaagcaggagcacgagacgtcctggcactacgaccaggaccacccctacaagacctgggcctaccacgggagctacgagaccaagcagaccggctccgcgagctccatggtgaacggggtcgtgcgcctgctgacgaagccgtgggacgtgctccccaccgtcacccagatggccatgaccgacacgacccccttcggccagcagcgcgtgttcaaggagaaggtggacacccggacccaggagcccaaggagggcacgaagaagctgatgaagatcaccgccgagtggctgtggaaggagctcgggaagaagaagaccccgcgcatgtgcacccgggaggagttcacgcgcaaggtccggagcaacgccgccctgggcgcgatcttcaccgacgagaacaagtggaagtccgcccgcgaggccgtggaggacagccggttctgggagctggtggacaaggagcgcaacctccacctggaggggaagtgcgagacctgcgtctacaacatgatgggcaagcgggagaagaagctgggggagttcggcaaggccaagggctcccgcgccatctggtacatgtggctcggggcgcggttcctggagttcgaggccctgggcttcctcaacgaggaccactggttcagccgcgagaactccctgagcggggtggagggcgaggggctgcacaagctcggctacatcctgcgggacgtcagcaagaaggagggcggggccatgtacgccgacgacaccgcgggctgggacacgcgcatcaccctggaggacctcaagaacgaggagatggtgaccaaccacatggagggggagcacaagaagctggccgaggccatcttcaagctgacctaccagaacaaggtggtccgggtgcagcgccccacgccccggggcaccgtgatggacatcatctcccgccgggaccagcgcgggagcggccaggtcggcacctacgggctcaacaccttcacgaacatggaggcccagctgatccggcagatggagggcgagggggtgttcaagaacatccagcacctgaccgtgaccgaggaggtcgccgtgcacaactggctcgcgcgcgtgggccgcgagcggctgtcccgcatggccatcagcggcgacgactgcgtcgtgaagcccctggacgaccggttcgccaacgccctcaccgccctgaacgacatggggaagatccgcaaggacatccagcagtgggagccgtccaagggctggaacgactggacgcaggtccccttctgcagccaccacttccacgagctgatcatgaaggacgggcgggtcctcgtggtgccctgccgcaaccaggacgagctgatcggccgggcgcgcatctcccagggggccggctggagcctgcgggagaccgcctgcctcggcaagtcctacgcccagatgtggagcctgatgtacttccaccgccgggacctgcgcctcgccgcgaacgccatctgctccgccgtccccagccactgggtgccgacctcccggaccacgtggagcatccacgccaagcacgagtggatgaccaccgaggacatgctgaccgtgtggaaccgcgtctggatccgggagaacccctggatggaggacaagacccccgtggagtcctgggaggagatcccctacctggggaagcgcgaggaccagtggtgcggcagcctcatcgggctgacgtcccgggccacctgggcgaagaacatccaggccgccatcaaccaggtgcgcagcctgatcggcaacgaggagtacaccgactacatgccgagcatgaagcggttccgccgcgaggaggaggaggccggggtcctctggtga

SEQ ID NO: 9506 - RNA, 9876 nt, synthetic construct
  misc_feature 1..9876: note = derived and/or modified CDS sequence (opt1) from DENV-2__EU660414__SS-prME
  source 1..9876: mol_type = other RNA
agcgcgggcatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctgggtcctgcggcacccgggcttcacgatcatggccgcgatcctggcctacaccatcgggaccacccacttccagcgcgtgctcatcttcatcctgctgacggccgtggccccctccatgaccatgcggtgcatcggcatcagcaaccgcgacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcggcctgttcggcaagggcgggatcgtgacgtgcgccatgttcacgtgcaagaagaacatggagggcaagatcgtgcagcccgagaacctggagtacaccatcgtcgtgacgccccactccggggaggagcacgcggtgggcaacgacacggggaagcacggccaggagatcaaggtcaccccgcagagctccatcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcaaccgcgacccgttcccccagagcaacgcccccatcatcgacgaggagcgggagatccccgagcgctcctggaacagcgggcacgagtgggtgaccgacttcaagggcaagacggtgtggttcgtcccgtccatcaaggcggggaacgacatcgccgcctgcctgcggaagaacggcaagaaggtgatccagctgagccgcaagaccttcgactccgagtacgtgaagacccggatcaacgactgggacttcgtcgtgaccacggacatcagcgagatgggcgccaacttcaaggcggagcgcgtgatcgacccccggcgctgcatgaagcccgtcatcctcaccgacggggaggagcgggtgatcctggccggccccatgccggtgacccactccagcgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgcgagaaggtcgacgccatcgacggcgagtaccggctgcgcggggaggcccgcaagacgttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgccgcgggccgcaagtccctgaccctcaacctgatcaccgagatgggccggctgcccacgttcatgacccagaagacccgcgacgccctcgacaacctggccgtgctgcacaccgccgaggccggcgggcgggcctacaaccacgccctcagcgagctgcccgagacgctggagaccctcctgctgctcaccctgctggccaccgtgaccggcgggatcttcctcttcctgatgtccgggcgcgggatcgggaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtgatcgccatcctgacggtcgtggccgcgaccatggccaacgagatgggcttcctggagaagaccaagaaggacctcgggctgggcagcatcgccacccagcagccggagtccaacatcctggacatcgacctccgccccgccagcgcctggacgctgtacgcggtggccaccaccttcgtcacccccatgctgcggcactccatcgagaacagcagcgtgaacgtgtccctcacggccatcgccaaccaggccaccgtcctgatgggcctggggaagggctggcccctcagcaagatggacatcggggtgccgctgctggcgatcggctgctactcccaggtgaaccccatcaccctcaccgccgccctgctgctcctggtcgcccactacgcgatcatcgggcccggcctgcaggccaaggccacgcgcgaggcccagaagcgggccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcacgacctgggccctctgcgaggccctgaccctggccaccgggcccatcagcacgctctgggagggctccccggggcggttctggaacaccaccatcgcggtcagcatggccaacatcttccgcggctcctacctggccggcgccgggctcctcttcagcatcatgaagaacaccacgaacacccggcgcggcaccgggaacatgggcgagaccctgggcgagaagtggaagtcccgcctgaacgccctcgggaagtccgagttccagatctacaagaagtccggcatccaggaggtggaccggacgctggcgaaggaggggatcaagcgcggcgagaccgaccaccacgccgtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgaccaagggcgggcccggccacgaggagcccatcccgatgtccacgtacgggtggaacctcgtccgcctgcagagcggcgtggacgtgttcttcatcccgcccgagaagtgcgacaccctgctctgcgacatcggggagtccagccccaacccgaccgtcgaggccggccggaccctgcgcgtgctgaacctcgtggagaactggctgaacaacaacacgcagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtggtccggctgctcaccaagccgtgggacgtgctgcccaccgtgacccagatggccatgacggacaccacccccttcgggcagcagcgcgtcttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtcgaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtgagcaagaaggagggcggcgccatgtacgccgacgacacggcggggtgggacacccggatcaccctcgaggacctgaagaacgaggagatggtcaccaaccacatggagggcgagcacaagaagctggccgaggccatcttcaagctcacgtaccagaacaaggtggtgcgcgtccagcggcccacgccccgggggaccgtgatggacatcatcagccggcgcgaccagcggggctccggccaggtggggacctacggcctgaacacgttcaccaacatggaggcccagctgatccgccagatggagggggagggcgtcttcaagaacatccagcacctcaccgtgaccgaggaggtggccgtccagaactggctggcgcgggtggggcgcgagcgcctgagccggatggccatctccggcgacgactgcgtggtcaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtcccgaccagccgcacgacctggtccatccacgccaagcacgagtggatgaccaccgaggacatgctgaccgtgtggaaccgggtgtggatccgcgagaacccctggatggaggacaagacgcccgtcgagagctgggaggagatcccctacctcggcaagcgggaggaccagtggtgcgggtccctgatcggcctgaccagccgcgccacctgggcgaagaacatccaggtggccatcaaccaggtgcggtccctcatcgggaacgaggagtacaccgactacatgccgagcatgaagcgcttccggcgcgaggaggaggaggccggcgtcctgtggtga

SEQ ID NO: 9507 - RNA, 9876 nt, synthetic construct
  misc_feature 1..9876: note = derived and/or modified CDS sequence (opt1) from DENV-2__EU660415__SS-prME
  source 1..9876: mol_type = other RNA
agcgccggcatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcgggctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggggccgggccagctgaagctcaactggttcaagaaggggtccagcatcggccagatgttcgagaccaccatgcgcggcgcgaagcgcatggccatcctgggggacaccgcctgggacttcggctccctcggcggggtgttcacgagcatcgggaaggccctccaccaggtcttcggcgccatctacggcgcggccttctccggggtgagctggaccatgaagatcctgatcggcgtgatcatcacctggatcgggatgaactcccggagcacctccctgagcgtctccctggtgctcgtgggcatcgtcacgctgtacctgggggtgatggtgcaggccgacagcggctgcgtcgtgtcctggaagaacaaggagctcaagtgcggcagcgggatcttcatcaccgacaacgtgcacacctggaccgagcagtacaagttccagcccgagagcccctccaagctggccagcgcgatccagaaggcccaggaggagggcatctgcgggatccgctccgtcacgcggctggagaacctcatgtggaagcagatcacccccgagctgaaccacatcctggccgagaacgaggtgaagctcaccatcatgaccggcgacatcaaggggatcatgcaggccggcaagcgcagcctgcggccgcagcccacggagctgaagtactcctggaagacctggggcaaggccaagatgctcagcaccgagtcctacaaccagaccttcctgatcgacgggcccgagacggcggagtgcccgaacaccaaccgcgcctggaacagcctggaggtggaggactacggcttcggggtcttcaccaccaacatctggctcaagctgaaggagaagcaggacgccttctgcgactccaagctgatgagcgccgccatcaaggacaaccgggcggtgcacgccgacatgggctactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccgggcccgtgagccagcacaactaccgcctgggctaccacacccagatcgcggggccgtggcacctgggcaagctcgagatggacttcgacttctgcgacgggaccaccgtgatcgtcacggaggactgcggcaaccggggcccctccctgcgcaccaccaccgccagcgggaagctgatcacggagtggtgctgccggagctgcaccctgccgcccctgcgctaccggggcgaggacgggtgctggtacggcatggagatccgcccgctgaaggagaaggaggagaacctcgtgaactccctggtgaccgccgggcacggccaggtcgacaacttcagcctgggcgtgctcgggatggccctgttcctggaggagatgctccggacccgcgtgggcacgaagcacgcgatcctgctggtcgccgtgtccttcgtgaccctcatcaccgggaacatgagcttcaaggacctgggccgggtcgtggtgatggtcggggccaccatggccgacgacatcggcatgggcgtgacgtacctggccctcctggcggccttcaaggtgcgccccaccttcgccgccgggctgctcctgcggaagctgacctccaaggagctcatgatgaccacgatcggcatcgtcctgctgagccagtccaccatccccgagaccgtgctcgagctgaccgacgccctggcgctcgggatgatggtgctgaagatcgtccgcaacatggagaagtaccagctggccgtgacgatcatggccatcctctgcgtccccaacgccgtgatcctgcagaacgcctggaaggtgagctgcaccatcctggcggtcgtgtccgtgagcccgctcctgctgacctccagccagcagaagaccgactggatccccctcgccctgacgatcaagggcctgaaccccaccgccatcttcctcaccaccctgtcccgcacgaacaagaagcggagctggcccctgaacgaggccatcatggcggtcggcatggtgtccatcctcgccagctccctgctgaagaacgacatcccgatgaccgggcccctcgtggccggcgggctgctgaccgtctgctacgtgctcaccggccgcagcgccgacctggagctggagcgggccacggacgtgaagtgggaggaccaggcggagatctccgggagcagccccatcctctccatcaccatcagcgaggacggctccatgagcatcaagaacgaggaggaggagcagaccctgaccatcctgatccgcacgggcctcctggtcatctccgggctgttccccatcagcatcccgatcaccgccgccgcctggtacctctgggaggtgaagaagcagcgggccggcgtgctgtgggacgtccccagcccgccgcccatggggaaggcggagctggaggacggcgcctaccgcatcaagcagaaggggatcctcggctacagccagatcggcgccggggtgtacaaggagggcaccttccacaccatgtggcacgtgacccgcggggcggtcctgatgcacaagggcaagcgcatcgagccctcctgggccgacgtgaagaaggacctgatcagctacgggggcggctggaagctcgagggggagtggaaggagggcgaggaggtgcaggtcctggcgctggagcccgggaagaacccccgggccgtgcagacgaagcccggcctcttcaagaccaacaccgggaccatcggcgccgtgtccctggacttcagccccggcacgtccgggagccccatcatcgacaagaagggcaaggtcgtggggctgtacggcaacggcgtggtcacccgctccggggcctacgtgagcgccatcgcgcagaccgagaagggcatcgaggacaacccggagatcgaggacgacatcttccggaagcgccggctgaccatcatggacctccaccccggggccggcaagacgaagcgctacctgcccgccatcgtgcgggaggccatcaagcgcgggctgcggaccctcatcctggcgcccacccgcgtcgtggccgccgagatggaggaggccctgcggggcctcccgatccgctaccagacccccgccatccgggcggagcacacgggccgcgagatcgtggacctgatgtgccacgccaccttcaccatgcgcctgctctcccccgtccgggtgcccaactacaacctgatcatcatggacgaggcccacttcaccgacccggccagcatcgccgcgcgcgggtacatctccacgcgggtggagatgggcgaggccgccgggatcttcatgaccgccacgccgcccggcagccgcgaccccttcccgcagagcaacgcccccatcatcgacgaggagcgggagatccccgagcgctcctggaacagcgggcacgagtgggtcaccgacttcaagggcaagacggtgtggttcgtgccctccatcaaggcgggcaacgacatcgccgcctgcctgcggaagaacgggaagaaggtcatccagctcagccgcaagaccttcgactccgagtacgtgaagacccggaccaacgactgggacttcgtggtcacgaccgacatcagcgagatgggcgccaacttcaaggcggagcgcgtgatcgacccgcggcgctgcatgaagcccgtgatcctgaccgacggggaggagcgggtcatcctggccggccccatgcccgtgacccactccagcgccgcccagcgccgggggcgcatcggccggaacccgaagaacgagaacgaccagtacatctacatgggcgagcccctcgagaacgacgaggactgcgcccactggaaggaggcgaagatgctgctggacaacatcaacacgcccgaggggatcatcccctccatgttcgagccggagcgcgagaaggtggacgccatcgacggcgagtaccggctccgcggggaggcccgcaagaccttcgtcgacctgatgcggcgcggcgacctgcccgtgtggctcgcctacaaggtggccgcggaggggatcaactacgccgaccggcgctggtgcttcgacggcatcaagaacaaccagatcctggaggagaacgtcgaggtggagatctggaccaaggagggcgagcggaagaagctgaagccccgctggctcgacgcccggatctacagcgacccgctggccctgaaggagttcaaggagttcgccgcggggcgcaagtccctcaccctgaacctgatcacggagatgggccggctccccaccttcatgacccagaagacccgcgacgccctggacaacctggccgtcctccacacggccgaggccgggggccgggcctacaaccacgccctgagcgagctgcccgagaccctcgagaccctgctgctcctgaccctgctcgccacggtgaccggcgggatcttcctgttcctgatgtccggccgcgggatcggcaagatgaccctcgggatgtgctgcatcatcaccgccagcatcctgctgtggtacgcgcagatccagccccactggatcgccgcctccatcatcctcgagttcttcctgatcgtgctgctcatcccggagcccgagaagcagcggacgccccaggacaaccagctgacgtacgtcgtgatcgccatcctgaccgtggtcgccgcgaccatggccaacgagatgggcttcctcgagaagaccaagaaggacttcggcctggggagcatcgccacgcagcagcccgagtccaacatcctggacatcgacctccgcccggccagcgcctggaccctgtacgcggtggccaccaccttcgtgacgcccatgctgcggcactccatcgagaacagcagcgtcaacgtgtccctcaccgccatcgccaaccaggccaccgtgctgatgggcctggggaagggctggcccctcagcaagatggacatcggggtccccctgctggcgatcggctgctactcccaggtgaacccgatcaccctcacggccgccctgctgctcctggtggcccactacgcgatcatcggccccgggctgcaggccaaggccacccgcgaggcccagaagcgggccgcggccggcatcatgaagaaccccaccgtcgacgggatcaccgtgatcgacctcgaccccatcccgtacgaccccaagttcgagaagcagctgggccaggtgatgctgctcatcctgtgcgtcacccaggtgctgatgatgcgcaccacctgggccctctgcgaggccctgaccctggccacggggcccatcagcaccctctgggagggcaaccccggccggttctggaacaccaccatcgcggtgtccatggccaacatcttccgcgggagctacctggccggcgccgggctcctcttctccatcatgaagaacacgaccaacacccggcgcggcaccggcaacatcggggagacgctgggcgagaagtggaagtcccgcctgaacgccctcggcaagagcgagttccagatctacaagaagtccgggatccaggaggtcgaccggaccctggcgaaggaggggatcaagcgcggcgagaccgaccaccacgccgtgtcccggggcagcgccaagctgcgctggttcgtggagcggaacatggtcaccccggaggggaaggtggtggacctcggctgcgggcgcggcgggtggtcctactactgcggcggcctgaagaacgtccgggaggtgaaggggctgacgaagggcgggcccggccacgaggagcccatccccatgagcacctacgggtggaacctcgtgcgcctgcagtccggcgtcgacgtgttcttcatcccgcccgagaagtgcgacaccctgctctgcgacatcggcgagagctcccccaaccccaccgtggaggccgggcggacgctgcgcgtcctgaacctcgtggagaactggctgaacaacaacacccagttctgcatcaaggtgctgaacccgtacatgcccagcgtcatcgagaagatggaggcgctgcagcggaagtacggcggggccctcgtgcgcaaccccctgtcccggaacagcacccacgagatgtactgggtgagcaacgcctccggcaacatcgtcagctccgtgaacatgatcagccgcatgctgatcaaccggttcaccatgcgccacaagaaggccacctacgagccggacgtggacctcgggtccggcacgcggaacatcggcatcgagagcgagatccccaacctggacatcatcgggaagcgcatcgagaagatcaagcaggagcacgagacctcctggcactacgaccaggaccacccctacaagacctgggcctaccacggcagctacgagaccaagcagacggggtccgcgagctccatggtcaacggcgtggtgcggctgctcaccaagccctgggacgtcctgccgaccgtgacccagatggccatgacggacaccacccccttcggccagcagcgcgtgttcaaggagaaggtcgacacccgcacgcaggagcccaaggaggggaccaagaagctgatgaagatcaccgccgagtggctctggaaggagctgggcaagaagaagacgccccggatgtgcacgcgcgaggagttcacccggaaggtgcgcagcaacgccgccctgggggcgatcttcaccgacgagaacaagtggaagtccgcccgggaggccgtggaggacagccgcttctgggagctcgtcgacaaggagcggaacctgcacctggagggcaagtgcgagacctgcgtgtacaacatgatggggaagcgcgagaagaagctcggcgagttcggcaaggccaaggggtcccgggccatctggtacatgtggctgggcgcgcgcttcctggagttcgaggccctcgggttcctgaacgaggaccactggttcagccgggagaactccctgagcggcgtcgagggggagggcctccacaagctgggctacatcctgcgcgacgtgtccaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggccgacgccccgcgggaccgtcatggacatcatcagccggcgcgaccagcggggcagcggccaggtggggacctacggcctgaacaccttcaccaacatggaggcccagctgatccgccagatggagggggagggcgtgttcaagaacatccagcacctcaccgtcaccgaggaggtggccgtgcagaactggctggcgcgggtcggccgcgagcgcctgtcccggatggccatcagcggggacgactgcgtggtgaagcccctcgacgaccgcttcgccaacgccctgacggccctgaacgacatgggcaagatccggaaggacatccagcagtgggagccctccaaggggtggaacgactggacccaggtcccgttctgcagccaccacttccacgagctcatcatgaaggacggccgcgtgctggtggtcccctgccggaaccaggacgagctgatcgggcgcgcgcggatctcccagggcgccggctggagcctccgcgagaccgcctgcctggggaagtcctacgcccagatgtggagcctgatgtacttccaccggcgcgacctccggctggccgcgaacgtgatctgctccgccgtgcccagccactgggtccccacctcccgcacgacctggagcatccacgccaagcacgagtggatgaccaccgaggacatgctgaccgtgtggaaccgggtgtggatccgcgagaacccgtggatggaggacaagacgcccgtcgagtcctgggaggagatcccctacctcggcaagcgggaggaccagtggtgcgggagcctgatcggcctgacctcccgcgccacctgggccaagaacatccaggcggccatcaaccaggtgcggagcctcatcgggaacgaggagtacaccgactacatgccctccatgaagcgcttccggcgcgaggaggaggaggccggcgtgctgtggtga

SEQ ID NO: 9508 - RNA, 9876 nt, synthetic construct
  misc_feature 1..9876: note = derived and/or modified CDS sequence (opt1) from DENV-2__EU687249__SS-prME
  source 1..9876: mol_type = other RNA
agcgcggggatgatcatcatgctgatccccaccgtgatggccttccacctcaccacccgcaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacatcctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccgcgaggaggggatctgcggcatccggtccgtgacgcgcctggagaacctcatgtggaagcagatcacccccgagctgaaccacatcctggccgagaacgaggtcaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtgttcaccaccaacatctggctcaagctgaaggagaagcaggacgccttctgcgactccaagctgatgagcgccgccatcaaggacaaccgcgcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccggccggggtaccacacccagatcgcgggcccctggcacctggggaagctggagatggacttcgacttctgcgacggcaccaccgtgatcgtgacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtcaactccctcgtgaccgccggccacggccaggtggacaacttcagcctgggcgtcctgggcatggccctcttcctggaggagatgctgcgcacccgggtggggacgaagcacgcgatcctcctggtggccgtctccttcatgaccctgatcaccggcaacatgagcttcaaggacctcgggcgcgtggtggtcatggtgggcgccaccatggccgacgacatcgggatgggcgtgacgtacctggccctgctcgcggccttcaaggtccggcccaccttcgccgccggcctgctgctccgcaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtgacgatcatggccatcctgtgcgtcccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcggagcgccgacctcgagctggagcgcgccacggacgtcaagtgggaggaccaggcggagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtgaagaagcagcgcgccggggtcctctgggacgtgcccagcccgccgcccatgggcaaggcggagctggaggacggggcctaccggatcaagcagaagggcatcctggggtacagccagatcggcgccggcgtgtacaaggaggggaccttccacaccatgtggcacgtcacccgcggcgccgtgctcatgcacaaggggaagcggatcgagccctcctgggccgacgtgaagaaggacctgatcagctacggcgggggctggaagctggagggcgagtggaaggagggggaggaggtccaggtgctcgcgctggagcccggcaagaacccccgcgccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtccgcgaggccatcaagcgggggctgcgcaccctgatcctcgcgccgacccgggtggtggccgccgagatggaggaggccctgcgcggcctgcccatccggtaccagacccccgccatccgcgcggagcacacggggcgcgagatcgtcgacctcatgtgccacgccaccttcaccatgcggctgctgagccccgtgcgcgtgccgaactacaacctcatcatcatggacgaggcccacttcaccgaccccgcctccatcgccgcgcggggctacatcagcacgcgcgtcgagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtgtggttcgtcccgagcatcaaggcggggaacgacatcgccgcctgcctgcgcaagaacggcaagaaggtgatccagctgtcccggaagaccttcgacagcgagtacgtgaagacccgcaccaacgactgggacttcgtcgtgacgaccgacatctccgagatgggcgccaacttcaaggcggagcgggtgatcgacccccgccggtgcatgaagcccgtcatcctcaccgacggggaggagcgcgtgatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtcgacgccatcgacggcgagtaccgcctgcgcggggaggcccggaagaccttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtcacgcccatgctgcgccacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgggaggcccagaagcgcgccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggaccacctgggccctctgcgaggccctgaccctggccacggggcccatctccaccctctgggagggcaacccggggcgcttctggaacaccaccatcgcggtcagcatggccaacatcttccggggctcctacctggccggcgccgggctcctcttcagcatcatgaagaacacgaccaacacccgccgcggcaccgggaacatcggcgagacgctgggcgagaagtggaagtcccggctgaacgccctcggcaagagcgagttccagatctacaagaagtccggcatccaggaggtggaccgcaccctggcgaaggaggggatcaagcggggcgagaccgaccaccacgccgtgagccgcgggtccgccaagctgcggtggttcgtcgagcgcaacatggtgacccccgagggccgggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgaggtgcccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcgcctgctcaccaagccgtgggacgtgctgcccaccgtcacccagatggccatgacggacaccacccccttcgggcagcagcgggtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgcgggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggtcgccgtgcagaactggctggcgcgcgtggggcgggagcgcctgagccggatggccatctccggcgacgactgcgtcgtgaagcccctcgacgaccgcttcgccaacgccctgacggccctgaacgacatgggcaagatccggaaggacatccagcagtgggagccgagcaaggggtggtccgactggacccaggtgcccttctgcagccaccacttccacgagctcatcatgaaggacggccgcgtcctggtggtgccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtccccagccactgggtgccgacctcccgcacgacctggagcatccacgccaagcacgagtggatgaccaccgaggacatgctgaccgtgtggaaccgggtctggatccgcgagaacccctggatggaggacaagacgcccgtggagtcctgggaggagatcccctacctcggcaagcgggaggaccagtggtgcgggagcctgatcggcctgacctcccgcgccacctgggcgaagaacatccaggccgccatcaaccaggtgcggagcctcatcgggaacgaggagtacaccgactacatgccgagcatgaagcgcttccgccgggaggaggaggaggccggcgtcctgtggtga

SEQ ID NO: 9509 - RNA, 9876 nt, synthetic construct
  misc_feature 1..9876: note = derived and/or modified CDS sequence (opt1) from DENV-2__EU660416__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagcgccggtacgtcctcggccgcctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcggatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccgcagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccggtccgtcacgcgcctggagaacctcatgtggaagcagatcacccccgagctgaaccacatcctggccgagaacgaggtgaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggatgaagcacgcgatcctcctggtcgccgtgtccttcgtgacgctgatcaccggcaacatgagcttcaaggacctcgggcgcgtcgtggtgatggtcggcgccaccatggccgacgacatcgggatgggcgtgacctacctggccctgctcgcggccttcaaggtgcggcccacgttcgccgccggcctgctgctccgcaagctgacctccaaggagctgatgatgaccaccatcgggatcgtcctcctgagccagtccacgatccccgagaccgtgctggagctcaccgacgccctggcgctgggcatgatggtgctcaagatcgtccgcaacatggagaagtaccagctggccgtgaccatcatgacgatcctgtgcgtcccgaacgccgtgatcctccagaacgcctggaaggtgagctgcaccatcctggccgtcgtgtccgtgagccccctgctcctgacctccagccggcagaagaccgactggatccccctggcgctcacgatcaaggggctgaaccccaccgccatcttcctgaccaccctctcccgcacgaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggccgagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgaccatcatggacctgcaccccggggcgggcaagacgaagcgctacctccccgccatcgtgcgggaggccatcaagcgcgggctgcggaccctgatcctcgccccgacccgcgtcgtggcggccgagatggaggaggccctgcggggcctgcccatccgctaccagacccccgccatccgcgccgagcacacggggcgggagatcgtggacctcatgtgccacgcgaccttcaccatgcgcctgctgagccccgtccgggtgccgaactacaacctcatcatcatggacgaggcccacttcaccgaccccgcctccatcgccgcccgcggctacatcagcacgcgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggccgggaacgacatcgcggcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggccgagcgcgtgatcgacccccggcgctgcatgaagcccgtgatcctcaccgacggggaggagcgggtcatcctggcgggccccatgccggtgacccacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgcgagaaggtggacgcgatcgacggcgagtaccgcctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgccggccgcaagagcctgaccctcaacctgatcacggagatgggccggctgcccaccttcatgacccagaagacccgcgacgcgctcgacaacctggccgtcctgcacacggccgaggccgggggccgggcgtacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacgtacgtcgtgatcgccatcctgaccgtggtcgccgccaccatggcgaacgagatgggcttcctggagaagaccaagaaggacctcgggctgggctccatcgccacgcagcagccggagagcaacatcctggacatcgacctccgccccgcctccgcctggaccctgtacgccgtggcgaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcaccctcacggcggccctgctgctcctggtggcccactacgccatcatcgggcccggcctgcaggcgaaggccacccgcgaggcccagaagcgggccgccgcgggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgccgtgagcatggcgaacatcttccgcggctcctacctggccggcgccgggctcctcttcagcatcatgaagaacacgaccaacacccgccggggcaccgggaacatgggcgagacgctgggcgagaagtggaagtcccgcctgaacgccctcgggaagtccgagttccagatctacaagaagtccggcatccaggaggtcgaccggaccctggccaaggaggggatcaagcgcggcgagaccgaccaccacgcggtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggccctgcagcggaagtacggcggggcgctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctcaccaagccgtgggacgtcctgcccaccgtgacccagatggcgatgacggacaccacccccttcgggcagcagcgggtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggccgggtgggacacccggatcaccctcgaggacctgaagaacgaggagatggtgaccaaccacatggagggcgagcacaagaagctggcggaggccatcttcaagctcacgtaccagaacaaggtcgtgcgcgtgcagcggcccacgccccgggggaccgtcatggacatcatcagccggcgcgaccagcggggctccggccaggtgggcacctacggcctgaacacgttcaccaacatggaggcccagctgatccgccagatggagggggagggcgtgttcaagaacatccagcacctcaccgtcaccgaggaggtggccgtgcagaactggctggcccgcgtcgggcgggagcgcctgagccggatggcgatctccggcgacgactgcgtggtgaagcccctcgacgaccgcttcgccaacgccctgacggccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgaccagccgcacgacctggtccatccacgccaagcacgagtggatgaccaccgaggacatgctgaccgtctggaacaaggtgtggatccgggagaacccctggatggaggacaagacgcccgtggagagctgggaggagatcccctacctcggcaagcgcgaggaccagtggtgcgggtccctgatcggcctgaccagccgggccacctgggccaagaacatccaggcggccatcaaccaggtccgctccctcatcgggaacgaggagtacaccgactacatgccgagcatgaagcggttccgccgcgaggaggaggaggccggcgtgctgtggtga

SEQ ID NO: 9510 - RNA, 9876 nt, synthetic construct
  misc_feature 1..9876: note = derived and/or modified CDS sequence (opt1) from DENV-2__EU660417__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagcgccggtacgtcctcggccgcctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcggatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccgcagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccggtccgtcacgcgcctggagaacctcatgtggaagcagatcacccccgagctgaaccacatcctggccgagaacgaggtgaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatgaccatcctgtgcgtcccgaacgccgtgatcctccagaacgcctggaaggtgagctgcaccatcctggccgtcgtgtccgtgagccccctgctcctgacctccagccggcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgcgccgagcacaccgggcgggagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccgcctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtcctgcacaccgccgaggccgggggccgggcgtacaaccacgccctctccgagctgcccgagaccctggagaccctcctgctgctcacgctgctggccaccgtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccaccatggcgaacgagatgggcttcctggagaagacgaagaaggacctcgggctgggctccatcgccacccagcagccggagagcaacatcctggacatcgacctccgccccgcctccgcctggaccctgtacgccgtggcgaccacgttcgtgacccccatgctgcggcacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcacgctcaccgcggccctgctgctcctggtggcccactacgccatcatcgggcccggcctgcaggcgaaggccacccgcgaggcccagaagcgggccgccgcgggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcagcccggggcggttctggaacaccacgatcgccgtgtccatggcgaacatcttccgcggcagctacctggccggcgccgggctcctcttctccatcatgaagaacaccaccaacacccgccggggcacggggaacatgggcgagaccctgggcgagaagtggaagtcccgcctgaacgccctcgggaagtccgagttccagatctacaagaagtccggcatccaggaggtcgaccggaccctggccaaggaggggatcaagcgcggcgagaccgaccaccacgcggtgtcccgggggagcgccaagctgcgctggttcgtggagcggaacatggtcacgcccgagggcaaggtggtggacctcggctgcgggcgcggcgggtggtcctactactgcggcgggctgaagaacgtccgggaggtgaagggcctgaccaagggcgggcccggccacgaggagcccatcccgatgagcacctacgggtggaacctcgtgcgcctgcagtccggcgtcgacgtgttcttcatcccgcccgagaagtgcgacaccctgctctgcgacatcggggagagctcccccaacccgacggtggaggccggccggaccctgcgcgtcctgaacctcgtggagaactggctgaacaacaacacccagttctgcatcaaggtgctgaacccctacatgcccagcgtcatcgagaagatggaggccctgcagcggaagtacggcggggcgctcgtgcgcaacccgctgagccggaactccacccacgagatgtactgggtgagcaacgcctccggcaacatcgtcagctccgtgaacatgatcagccgcatgctgatcaaccggttcaccatgcgccacaagaaggccacgtacgagcccgacgtggacctcgggtccggcacccggaacatcgggatcgagagcgagatccccaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtcaacggcgtggtgcgcctgctcaccaagccgtgggacgtcctgcccaccgtgacgcagatggcgatgaccgacaccacccccttcgggcagcagcgggtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgcagcaacgccgccctgggggccatcttcaccgacgagaacaagtggaagtccgcgcgggaggccgtggaggacagccgcttctgggagctcgtcgacaaggagcggaacctgcacctggagggcaagtgcgagacgtgcgtgtacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtcgagggggagggcctccacaagctggggtacatcctgcgcgacgtgagcaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtcgtgcgcgtgcagcggcccacgccccgggggaccgtcatggacatcatctcccggcgcgaccagcggggcagcggccaggtgggcacgtacggcctgaacaccttcaccaacatggaggcccagctgatccgccagatggagggggagggcgtgttcaagaacatccagcacctcaccgtcacggaggaggtggccgtgcagaactggctggcccgcgtcgggcgggagcgcctgtcccggatggcgatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcccggatctcccagggcgcggggtggagcctccgcgagaccgcctgcctgggcaagtcctacgcccagatgtggagcctgatgtacttccaccggcgcgacctccggctggccgccaacgcgatctgctccgccgtgcccagccactgggtgccgacgtcccgcaccacctggagcatccacgccaagcacgagtggatgaccaccgaggacatgctgacggtctggaacaaggtgtggatccgggagaacccctggatggaggacaagacccccgtggagtcctgggaggagatcccctacctcggcaagcgcgaggaccagtggtgcgggagcctgatcggcctgacctcccgggccacctgggccaagaacatccaggcggccatcaaccaggtccgcagcctcatcgggaacgaggagtacacggactacatgccgagcatgaagcggttccgccgcgaggaggaggaggccggcgtgctgtggtga

SEQ ID NO: 9511 - RNA, 9876 nt, synthetic construct
  misc_feature 1..9876: note = derived and/or modified CDS sequence (opt1) from DENV-2__EU677137__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgagcagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggcccccagcatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgacggtcaccgaggactgcgggtcccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctcttcctggaggagatgctgcggacgcgcgtggggaccaagcacgcgatcctcctggtcgccgtgagcttcgtgaccctgatcaccggcaacatgtccttcaaggacctcgggcgggtcgtggtgatggtcggcgccacgatggccgacgacatcgggatgggcgtgacctacctggccctgctcgcggccttcaaggtgcgccccaccttcgccgccggcctgctgctccggaagctgaccagcaaggagctgatgatgacgaccatcgggatcgtcctcctgtcccagagcaccatccccgagaccgtgctggagctcacggacgccctggcgctgggcatgatggtgctcaagatcgtccgcaacatggagaagtaccagctggccgtgaccatcatggccatcctgtgcgtcccgaacgccgtgatcctccagaacgcctggaaggtgtcctgcaccatcctggcggtcgtgagcgtgagccccctgctcctgaccagctcccagcagaagacggactggatccccctggccctcaccgtcaaggggctgaaccccaccgccatcttcctgaccacgctcagccgcaccaacaagaagcggtcctggccgctgaacgaggccatcatggcggtgggcatggtgagcatcctggcctccagcctcctgaagaacgacatccccatgaccggccccctggtcgccgggggcctcctgaccgtgtgctacgtgctgacggggcgctccgccgacctcgagctggagcgggccaccgacgtcaagtgggaggaccaggcggagatcagcggcagctcccccatcctgagcatcaccatctccgaggacgggagcatgtccatcaagaacgaggaggaggagcagaccctcacgatcctgatccgcaccggcctgctcgtgatcagcggcctgttcccgatctccatccccatcaccgccgccgcctggtacctgtgggaggtgaagaagcagcgggccggggtcctctgggacgtgccctccccgccgcccatgggcaaggcggagctggaggacggggcctaccgcatcaagcagaagggcatcctggggtactcccagatcggcgccggcgtgtacaaggaggggaccttccacaccatgtggcacgtcacgcggggcgccgtgctcatgcacaaggggaagcgcatcgagcccagctgggccgacgtgaagaaggacctgatctcctacggcgggggctggaagctggagggcgagtggaaggagggggaggaggtccaggtgctcgcgctggagcccggcaagaacccccgggccgtgcagaccaagcccgggctgttcaagaccaacaccggcacgatcggggccgtcagcctcgacttctcccccggcaccagcggctcccccatcatcgacaagaaggggaaggtggtgggcctgtacgggaacggcgtcgtgacccgcagcggcgcctacgtgtccgccatcgcgcagaccgagaagtccatcgaggacaaccccgagatcgaggacgacatcttccggaagcgccggctgacgatcatggacctgcaccccggggccggcaagaccaagcgctacctccccgccatcgtccgggaggccatcaagcgcgggctgcggaccctgatcctcgcgccgacccgcgtggtggccgccgagatggaggaggccctgcggggcctgcccatccgctaccagacgcccgccatccgggcggagcacaccgggcgcgagatcgtcgacctcatgtgccacgccaccttcaccatgcgcctgctgtcccccgtgcgggtgccgaactacaacctcatcatcatggacgaggcccacttcacggaccccgccagcatcgccgcgcgcggctacatcagcacccgggtcgagatgggcgaggccgccgggatcttcatgaccgccacgccgcccggctcccgcgacccgttcccccagagcaacgcccccatcatcgacgaggagcgggagatccccgagcgctcctggaacagcgggcacgagtgggtgacggacttcaagggcaagaccgtgtggttcgtcccgtccatcaaggcggggaacgacatcgccgcctgcctgcggaagaacggcaagaaggtgatccagctgagccgcaagaccttcgactccgagtacgtgaagacccggacgaacgactgggacttcgtcgtgaccaccgacatcagcgagatgggcgccaacttcaaggcggagcgcgtgatcgacccccggcgctgcatgaagcccgtcatcctcaccgacggggaggagcgggtgatcctggccggccccatgccggtgacgcactccagcgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgccgcgggccgcaagtccctgacgctcaacctgatcaccgagatgggccggctgcccaccttcatgacccagaagacgcgcgacgccctcgacaacctggccgtgctgcacaccgccgaggccggcgggcgggcctacaaccacgccctcagcgagctgcccgagaccctggagaccctcctgctgctcacgctgctggccaccgtgaccgggggcatcttcctcttcctgatgtccggccgcgggatcggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtgatcgccatcctgaccgtcgtggccgcgaccatggccaacgagatgggcttcctggagaagacgaagaaggacctcgggctgggcagcatcgccacccagcagccggagtccaacatcctggacatcgacctccgccccgccagcgcctggaccctgtacgcggtggccaccacgttcgtcacccccatgctgcggcacagcatcgagaactccagcgtgaacgtgtccctcaccgccatcgccaaccaggccaccgtcctgatgggcctggggaagggctggcccctcagcaagatggacatcggggtgccgctgctggcgatcggctgctactcccaggtgaaccccatcacgctcaccgccgccctgctgctcctggtcgcccactacgcgatcatcgggcccggcctgcaggccaaggccacccgcgaggcccagaagcgggccgcggccggcatcatgaagaaccccaccgtggacgggatcacggtgatcgacctcgacccgatcccctacgaccccaagttcgagaagcagctgggccaggtcatgctgctcatcctgtgcgtgacccaggtgctgatgatgcgcaccacctgggccctctgcgaggccctgacgctggccaccgggcccatcagcaccctctgggagggcaacccggggcggttctggaacaccacgatcgcggtctccatggccaacatcttccgcggcagctacctggccggcgccgggctcctcttctccatcatgaagaacaccaccaacacccggcgcggcacggggaacatgggcgagaccctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgtcccgggggagcgccaagctgcgctggttcgtcgagcggaacatggtgacgcccgagggcaaggtggtcgacctcggctgcgggcgcggcgggtggtcctactactgcggcgggctgaagaacgtgcgggaggtgaagggcctgaccaagggcgggcccggccacgaggagcccatcccgatgagcacctacgggtggaacctcgtccgcctgcagtccggcgtggacgtgttcttcatcccgcccgagaagtgcgacaccctgctctgcgacatcggggagagctcccccaacccgacggtcgaggccggccggaccctgcgcgtgctgaacctcgtggagaactggctgaacaacaacacccagttctgcatcaaggtcctgaacccctacatgcccagcgtgatcgagaagatggaggcgatgcagcggaagtacggcggggccctggtgcgcaacccgctcagccggaactccacccacgagatgtactgggtcagcaacgcctccggcaacatcgtgagctccgtgaacatgatcagccgcatgctgatcaaccggttcaccatgcgccacaagaaggccacgtacgagcccgacgtcgacctggggtccggcacccggaacatcgggatcgagagcgagatccccaacctcgacatcatcggcaagcgcatcgagaagatcaagcaggagcacgagacctcctggcactacgaccaggaccacccctacaagacctgggcctaccacggcagctacgagacgaagcagaccgggtccgcgagctccatggtgaacggcgtggtccggctgctgaccaagccgtgggacgtgctccccaccgtgacgcagatggccatgaccgacaccacccccttcgggcagcagcgcgtcttcaaggagaaggtggacacgcgcacccaggagcccaaggagggcaccaagaagctgatgaagatcaccgccgagtggctgtggaaggagctcggcaagaagaagacgccgcggatgtgcacccgcgaggagttcacccggaaggtgcgcagcaacgccgccctgggggcgatcttcaccgacgagaacaagtggaagtccgcccgggaggccgtcgaggacagccgcttctgggagctggtggacaaggagcggaacctccacctggagggcaagtgcgagacgtgcgtctacaacatgatggggaagcgcgagaagaagctgggcgagttcgggaaggccaagggctcccgggccatctggtacatgtggctcggcgcgcgcttcctggagttcgaggccctggggttcctcaacgaggaccactggttcagccgggagaactccctgagcggcgtggagggggagggcctgcacaagctcgggtacatcctgcgcgacgtgagcaagaaggagggcggcgccatgtacgccgacgacaccgcggggtgggacacccggatcaccctggaggacctcaagaacgaggagatggtcacgaaccacatggagggcgagcacaagaagctggccgaggccatcttcaagctgacctaccagaacaaggtggtgcgcgtccagcggcccacgccccgggggaccgtgatggacatcatctcccggcgcgaccagcggggcagcggccaggtggggacgtacggcctcaacaccttcaccaacatggaggcccagctgatccgccagatggagggggagggcgtcttcaagaacatccagcacctgaccgtgacggaggaggtggccgtccagaactggctcgcgcgggtggggcgcgagcgcctgtcccggatggccatcagcggcgacgactgcgtggtcaagcccctggacgaccgcttcgccaacgccctcaccgccctgaacgacatgggcaagatccggaaggacatccagcagtgggagccgtccaaggggtggaacgactggacccaggtgcccttctgcagccaccacttccacgagctgatcatgaaggacggccgcgtgctcgtcgtgccctgccggaaccaggacgagctgatcgggcgcgcgcggatctcccagggcgccgggtggagcctgcgcgagaccgcctgcctcggcaagtcctacgcccagatgtggagcctgatgtacttccaccggcgcgacctgcggctcgccgcgaacgccatctgctccgccgtgcccagccactgggtcccgacgtcccgcaccacctggagcatccacgccaagcacgagtggatgaccaccgaggacatgctgacggtgtggaaccgggtgtggatccgcgagaacccctggatggaggacaagacccccgtcgagtcctgggaggagatcccctacctgggcaagcgggaggaccagtggtgcgggagcctcatcggcctgacctcccgcgccacctgggcgaagaacatccaggccgccatcaaccaggtgcggagcctgatcgggaacgaggagtacacggactacatgccgagcatgaagcgcttccggcgcgaggaggaggaggccggcgtgctctggtga

SEQ ID NO: 9512 - RNA, 9876 nt, synthetic construct
  misc_feature 1..9876: note = derived and/or modified CDS sequence (opt1) from DENV-2__EU677138__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggccgcgcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccgcggcaccgggaacatgggcgagacgctgggcgagaagtggaagtcccggctgaacgccctcggcaagagcgagttccagatctacaagaagtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagacccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtcaacggcgtggtgcgcctgctcaccaagccgtgggacgtcctgcccaccgtgacgcagatggccatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacgtgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgcggggtgggacacccgcatcaccctcgaggacctgaagaacgaggagatggtgacgaaccacatggagggcgagcacaagaagctggccgaggccatcttcaagctcacctaccagaacaaggtcgtgcgggtgcagcgccccacgccccgggggaccgtcatggacatcatcagccgccgggaccagcgcggctccggccaggtggggacgtacggcctgaacaccttcaccaacatggaggcccagctgatccggcagatggagggggagggcgtgttcaagaacatccagcacctcaccgccacggaggaggtcgcggtgcagaactggctggcccgcgtggggcgcgagcggctgagccgcatggccatctccggcgacgactgcgtcgtgaagcccctcgacgaccggttcgccaacgccctgaccgcgctgaacgacatgggcaagatccgcaaggacatccagcagtgggagccgagcaaggggtggaacgactggacccaggtgcccttctgctcccaccacttccacgagctcatcatgaaggacggccgggtcctggtggtgccctgccgcaaccaggacgagctgatcgggcgggcccgcatcagccagggcgccgggtggtccctccgggagaccgcctgcctgggcaagagctacgcccagatgtggtccctgatgtacttccaccgccgggacctccgcctggcggccaacgccatctgcagcgccgtcccctcccactgggtgccgacgagccggaccacctggtccatccacgccaagcacgagtggatgaccaccgaggacatgctgacggtgtggaaccgcgtctggatccgggagaacccctggatggaggacaagacccccgtggagagctgggaggagatcccctacctcggcaagcgcgaggaccagtggtgcgggtccctgatcggcctgaccagccgggcgacctgggccaagaacatccaggtggccatcaaccaggtccgctccctcatcgggaacgaggagtacacggactacatgccgagcatgaagcggttccgccgcgaggaggaggaggccggcgtgctgtggtga

SEQ ID NO: 9513 - RNA, 9876 nt, synthetic construct
  misc_feature 1..9876: note = derived and/or modified CDS sequence (opt1) from DENV-2__EU677149__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagcgccggtacgtcctcggccgcctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcggatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccgcagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccggtccgtcacgcgcctggagaacctcatgtggaagcagatcacccccgagctgaaccacatcctggccgagaacgaggtgaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatgaccatcctgtgcgtcccgaacgccgtgatcctccagaacgcctggaaggtgagctgcaccatcctggccgtcgtgtccgtgagccccctgctcctgacctccagccggcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgcgccgagcacaccgggcgggagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccgcctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtcctgcacaccgccgaggccgggggccgggcgtacaaccacgccctctccgagctgcccgagaccctggagaccctcctgctgctcacgctgctggccaccgtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccaccatggcgaacgagatgggcttcctggagaagacgaagaaggacctcgggctgggctccatcgccacccagcagccggagagcaacatcctggacatcgacctccgccccgcctccgcctggaccctgtacgccgtggcgaccacgttcgtgacccccatgctgcggcacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcacgctcaccgcggccctgctgctcctggtggcccactacgccatcatcgggcccggcctgcaggcgaaggccacccgcgaggcccagaagcgggccgccgcgggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcaacccggggcggttctggaacaccacgatcgccgtgagcatggcgaacatcttccgcggctcctacctggccggcgccgggctcctcttcagcatcatgaagaacaccaccaacacccgccggggcacggggaacatgggcgagaccctgggcgagaagtggaagtcccgcctgaacgccctcgggaagtccgagttccagatctacaagaagtccggcatccaggaggtcgaccggaccctggccaaggaggggatcaagcgcggcgagaccgaccaccacgcggtgagccgggggtccgccaagctgcgctggttcgtggagcggaacatggtcacgcccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgacggtggaggccggccggaccctgcgcgtcctgaacctcgtggagaactggctgaacaacaacacccagttctgcatcaaggtgctgaacccctacatgccctccgtcatcgagaagatggaggccctgcagcggaagtacggcggggcgctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacgtacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctgctcaccaagccgtgggacgtcctgcccaccgtgacgcagatggcgatgaccgacaccacccccttcgggcagcagcgggtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtcgtgcgcgtgcagcggcccacgccccgggggaccgtcatggacatcatcagccggcgcgaccagcggggctccggccaggtgggcacgtacggcctgaacaccttcaccaacatggaggcccagctgatccgccagatggagggggagggcgtgttcaagaacatccagcacctcaccgtcacggaggaggtggccgtgcagaactggctggcccgcgtcgggcgggagcgcctgagccggatggcgatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaacaaggtgtggatccgggagaacccctggatggaggacaagacccccgtggagagctgggaggagatcccctacctcggcaagcgcgaggaccagtggtgcgggtccctgatcggcctgaccagccgggccacctgggccaagaacatccaggcggccatcaaccaggtccgctccctcatcgggaacgaggagtacacggactacatgccgagcatgaagcggttccgccgcgaggaggaggaggccggcgtgctgtggtga

SEQ ID NO: 9514 - RNA, 9876 nt, synthetic construct
  misc_feature 1..9876: note = derived and/or modified CDS sequence (opt1) from DENV-2__FJ024452__SS-prME
  source 1..9876: mol_type = other RNA
agcgccggcatgatcatcatgctgatccccaccgtgatggccttccacctcaccacccggaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgggcaccgccgggagaagcgcagcgtcgccctggtgccccacgtgggcatggggctcgagacgcggaccgagacctggatgtccagcgagggcgcctggaagcacgcccagcgcatcgagacctggatcctgcggcacccggggttcacgatcatggccgcgatcctggcctacaccatcggcaccacccacttccagcgcgtcctcatcttcatcctgctgacggccgtggccccctccatgaccatgcggtgcatcggcatcagcaaccgcgacttcgtggagggggtctccggcgggagctgggtggacatcgtgctcgagcacggctcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcatctgcaagcacagcatggtggaccgcgggtggggcaacgggtgcggcctcttcgggaagggcggcatcgtgacgtgcgccatgttcacgtgcaagaagaacatggaggggaagatcgtccagcccgagaacctggagtacaccatcgtggtgacgccccactccggcgaggagcacgcggtcgggaacgacacgggcaagcacgggaaggagatcaaggtgaccccgcagagctccatcaccgaggccgagctgaccggctacggcaccgtgacgatggagtgcagcccccggaccgggctcgacttcaacgagatggtcctgctgcagatggagaacaaggcctggctcgtgcaccgccagtggttcctggacctgcccctcccctggctgccgggcgccgacaagcaggagtccaactggatccagaaggagaccctggtgaccttcaagaacccccacgccaagaagcaggacgtcgtggtcctcgggagccaggagggcgcgatgcacacggccctgaccggggccaccgagatccagatgagctccggcaacctgctgttcaccggccacctgaagtgccggctgcgcatggacaagctccagctgaaggggatgagctactccatgtgcacgggcaagttcaaggtggtgaaggagatcgccgagacccagcacgggaccatcgtcatccgggtgcagtacgagggcgacggcagcccctgcaagatccccttcgagatcatggacctggagaagcgctacgtgctcgggcggctgatcaccgtcaacccgatcgtgacggagaaggactcccccgtgaacatcgaggccgagccgcccttcggcgacagctacatcatcatcggggtcgagccgggccagctgaagctcaactggttcaagaaggggtccagcatcggccagatgttcgagaccaccatgcgcggcgcgaagcgcatggccatcctgggggacaccgcctgggacttcggctccctcggcggggtgttcacgagcatcgggaaggccctccaccaggtgttcggggccatctacggcgcggccttctccggggtcagctggaccatgaagatcctgatcggcgtgatcatcacctggatcgggatgaactcccggagcacctccctgagcgtgtccctggtcctcgtgggcatcgtgacgctgtacctgggggtcatggtgcaggccgacagcggctgcgtggtctcctggaagaacaaggagctcaagtgcggcagcgggatcttcatcaccgacaacgtgcacacctggaccgagcagtacaagttccagcccgagagcccctccaagctggccagcgcgatccagaaggcccaggaggagggcatctgcgggatccgctccgtgacgcggctggagaacctcatgtggaagcagatcacccccgagctgaaccacatcctggccgagaacgaggtcaagctcaccatcatgaccggcgacatcaaggggatcatgcaggccggcaagcgcagcctgcggccgcagcccacggagctgaagtactcctggaagacctggggcaaggccaagatgctcagcaccgagtcctacaaccagaccttcctgatcgacgggcccgagacggcggagtgcccgaacaccaaccgcgcctggaacagcctggaggtggaggactacggcttcggggtgttcaccaccaacatctggctcaagctgaaggagaagcaggacgccttctgcgactccaagctgatgagcgccgccatcaaggacaaccgggcggtccacgccgacatgggctactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccgggcccgtcagccagcacaactaccgcccgggctaccacacccagatcgcggggccctggcacctgggcaagctggagatggacttcgacttctgcgacgggaccaccgtgatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtcaactccctcgtgaccgccgggcacggccaggtggacaacttcagcctgggcgtcctggggatggccctcttcctggaggagatgctgcggacccgcgtgggcacgaagcacgcgatcctcctggtggccgtctccttcgtgaccctgatcaccgggaacatgagcttcaaggacctcggccgggtggtcgtgatggtgggggccaccatggccgacgacatcggcatgggcgtcacgtacctggccctgctcgcggccttcaaggtgcgccccaccttcgccgccgggctgctgctccggaagctgacctccaaggagctgatgatgaccacgatcggcatcgtgctcctgagccagtccaccatccccgagaccgtcctggagctcaccgacgccctggcgctggggatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaagggcctgaaccccaccgccatcttcctgaccaccctctcccgcacgaacaagaagcggagctggccgctgaacgaggccatcatggcggtgggcatggtctccatcctggccagctccctcctgaagaacgacatccccatgaccgggcccctggtggccggcgggctcctgaccgtgtgctacgtcctgaccggccgcagcgccgacctcgagctggagcgggccacggacgtgaagtgggaggaccaggcggagatctccgggagcagccccatcctgtccatcaccatcagcgaggacggctccatgagcatcaagaacgaggaggaggagcagaccctcaccatcctgatccgcacgggcctgctcgtgatctccgggctgttcccgatcagcatccccatcaccgccgccgcctggtacctgtgggaggtcaagaagcagcgggccggcgtgctctgggacgtgcccagcccgccgcccatggggaaggcggagctggaggacggcgcctaccgcatcaagcagaaggggatcctgggctacagccagatcggcgccggggtctacaaggagggcaccttccacaccatgtggcacgtgacccgcggggcggtgctcatgcacaagggcaagcgcatcgagccctcctgggccgacgtcaagaaggacctgatcagctacgggggcggctggaagctggagggggagtggaaggagggcgaggaggtccaggtgctcgcgctggagcccgggaagaacccccgggccgtccagacgaagcccggcctgttcaagaccaacaccgggaccatcggcgccgtgtccctcgacttcagccccggcacgtccgggagccccatcatcgacaagaagggcaaggtggtcgggctgtacggcaacggcgtggtgacccgctccggggcctacgtcagcgccatcgcgcagaccggcaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtggtcgccgccgagatggaggaggccctgcggggcctgcccatccgctaccagacccccgccatccgggcggagcacacgggccgcgagatcgtggacctcatgtgccacgccaccttcaccatgcgcctgctgagccccgtgcgggtcccgaactacaacctcatcatcatggacgaggcccacttcaccgaccccgcctccatcgccgcgcgcgggtacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtctggttcgtgccgagcatcaaggcgggcaacgacatcgccgcctgcctgcggaagaacgggaagaaggtgatccagctgtcccgcaagaccttcgacagcgagtacgtcaagacccggatcaacgactgggacttcgtggtgaccacggacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggcgagcccctggagaacgacgaggactgcgcccactggaaggaggcgaagatgctcctggacaacatcaacacccccgaggggatcatcccgagcatgttcgagcccgagcgcgagaaggtggacgccatcgacggcgagtaccggctgcgcggggaggcccgcaagacgttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggcgagcggaagaagctgaagccgcgctggctggacgcccggatctactccgaccccctcgccctgaaggagttcaaggagttcgccgcggggcgcaagagcctgaccctcaacctgatcaccgagatgggccggctgcccacgttcatgacccagaagacccgcgacgccctcgacaacctggccgtgctgcacaccgccgaggccgggggccgggcctacaaccacgccctctccgagctgcccgagacgctggagaccctcctgctgctcaccctgctggccaccgtcacgggcgggatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgacggtggtggccgcgaccatggccaacgagatgggcttcctggagaagaccaagaaggacctcggcctggggtccatcgccacccagcagccggagagcaacatcctggacatcgacctccgccccgcctccgcctggacgctgtacgcggtcgccaccaccttcgtgacccccatgctgcggcacagcatcgagaacagctccgtgaacgtcagcctcacggccatcgccaaccaggccaccgtgctgatgggcctggggaagggctggcccctctccaagatggacatcggggtgccgctgctggcgatcggctgctacagccaggtcaaccccatcaccctcaccgccgccctgctgctcctggtggcccactacgcgatcatcggccccgggctgcaggccaaggccacgcgcgaggcccagaagcgggccgcggccggcatcatgaagaaccccaccgtggacgggatcaccgtcatcgacctcgacccgatcccctacgaccccaagttcgagaagcagctgggccaggtgatgctgctcatcctgtgcgtgacccaggtcctgatgatgcgcacgacctgggccctctgcgaggccctgaccctggccaccgggcccatctccacgctctgggagggcaacccgggccggttctggaacaccaccatcgcggtgagcatggccaacatcttccgcgggtcctacctggccggcgccgggctcctgttcagcatcatgaagaacaccacgaacacccggcgcggcaccggcaacatcggggagaccctgggcgagaagtggaagtcccgcctgaacgccctcgggaagtccgagttccagatctacaagaagtccggcatccaggaggtggaccggacgctggcgaaggaggggatcaagcgcggcgagaccgaccaccacgccgtcagccggggctccgccaagctgcgctggttcgtggagcggaacatggtgacccccgaggggaaggtcgtggacctcggctgcgggcgcggcgggtggagctactactgcggcggcctgaagaacgtgcgggaggtcaaggggctgaccaagggcgggcccggccacgaggagcccatcccgatgtccacgtacgggtggaacctcgtgcgcctgcagagcggcgtggacgtcttcttcatcccgcccgagaagtgcgacaccctgctctgcgacatcggcgagtccagccccaacccgaccgtggaggccgggcggaccctgcgcgtgctgaacctcgtcgagaactggctgaacaacaacacgcagttctgcatcaaggtgctgaacccctacatgccctccgtgatcgagaagatggaggcgctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacccggaacatcggcatcgagtccgagatccccaacctggacatcatcgggaagcgcatcgagaagatcaagcaggagcacgagacgagctggcactacgaccaggaccacccctacaagacctgggcctaccacggctcctacgagaccaagcagaccgggagcgcgtccagcatggtgaacggcgtcgtgcggctgctcacgaagccgtgggacgtgctgcccaccgtcacccagatggccatgaccgacacgacccccttcggccagcagcgcgtgttcaaggagaaggtggacacccgcacccaggagcccaaggaggggacgaagaagctgatgaagatcaccgccgagtggctctggaaggagctgggcaagaagaagaccccgcggatgtgcacccgcgaggagttcacgcggaaggtccgctccaacgccgccctgggggcgatcttcaccgacgagaacaagtggaagtccgcccgggaggccgtggaggactcccgcttctgggagctcatcgacaaggagcggaacctgcacctggagggcaagtgcgagacctgcgtgtacaacatgatggggaagcgcgagaagaagctcggcgagttcggcaaggccaaggggagccgggccatctggtacatgtggctgggcgcgcgcttcctggagttcgaggccctcgggttcctgaacgaggaccactggttctcccgggagaacagcctgtccggcgtcgagggggagggcctccacaagctgggctacatcctgcgcgacgtgagcaagaaggagggcggcgccatgtacgccgacgacaccgcggggtgggacacgcggatcaccctcgaggacctgaagaacgaggagatggtcaccaaccacatggagggcgagcacaagaagctggccgaggccatcttcaagctcacctaccagaacaaggtggtgcgcgtccagcggcccacgccccgcgggaccgtgatggacatcatcagccggcgcgaccagcggggctccggccaggtggggacctacggcctgaacaccttcacgaacatggaggcccagctgatccgccagatggagggggagggcgtcttcaagaacatccagcacctcaccgtgaccgaggaggtggccgtccagaactggctggcgcgggtgggccgcgagcgcctgagccggatggccatctccggggacgactgcgtggtcaagcccctcgacgaccgcttcgccaacgccctgaccgccctgaacgacatgggcaaggtgcggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgcgcgcgcccggatcagccagggggccggctggtccctccgcgagaccgcctgcctgggcaagagctacgcccagatgtggtccctgatgtacttccaccggcgcgacctccggctggcggccaacgccatctgcagcgccgtcccctcccactgggtgccgaccagccgcaccacgtggtccatccacgccaagcacgagtggatgaccaccgaggacatgctgaccgtgtggaaccgggtctggatccgcgagaacccctggatggaggacaagacccccgtggagagctgggaggagatcccctacctcgggaagcgggaggaccagtggtgcggctccctgatcgggctgacgagccgcgcgacctgggccaagaacatccaggccgccatcaaccaggtgcggtccctcatcggcaacgaggagtacaccgactacatgccgagcatgaagcgcttccggcgcgaggaggaggaggcgggggtcctgtggtga

SEQ ID NO: 9515 - RNA, 9876 nt, synthetic construct
  misc_feature 1..9876: note = derived and/or modified CDS sequence (opt1) from DENV-2__FJ205877__SS-prME
  source 1..9876: mol_type = other RNA
agcgccgggatgatcatcatgctgatccccaccgtgatggccttccacctcaccacccgcaacggggagccgcacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgagcagcgagggggcctggaagcacgcccagcgcatcgagacctggatcctgcggcaccccggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagcgccggtacgtcctcggccgcctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcggatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccgcagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccggtccgtcacgcgcctggagaacctcatgtggaagcagatcacccccgagctgaaccacatcctggccgagaacgaggtgaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatgaccatcctgtgcgtcccgaacgccgtgatcctccagaacgcctggaaggtgagctgcaccatcctggccgtcgtgtccgtgagccccctgctcctgacctccagccggcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgcgccgagcacaccgggcgggagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccgcctgcgcggggaggcccgcaagaccttcgtcgacctcatgcggcgcggcgacctgcccgtgtggctggcctacaaggtggccgccgaggggatcaactacccggaccggcgctggtgcttcgacggcatcaagaacaaccagatcctcgaggagaacgtcgaggtggagatctggcccaaggagggggagcggaagaagctgaagccccgctggctggacccccggatctactccgagccgcgcgcgctcaaggagttcaaggagttcccgcccggccggaagtccctgaccctgaacctcatcacggagatgggccgcctgcccaccttcatgacccagaagacccgggacgccctggacaacctcgccgggctgcacacggccgaggccggcgggcgcgcggacaaccacgccctgtccgagctcgccgagaccctggagaccctgctcctgctgaccctcctggccacgggcaccggcgggatcttcctgttcctcatgagcggccgggggatcggcaagatgaccctggggatgtgctgcatcatcaccgcgtccatcctgctctgggacgcccagatccagccgcactggatcgccgccagcatcatcctggagttcttcctgatcgtcctcctgatccccgagcccgagaagcagcgcacgccccaggacaaccagctgacgtacgtggtgatcgccatcctcaccgtcgtgggcgcgaccatgccgaacgagatgggcttcctggagaagaccaagaaggacctggggctcggctccatcgccacgcagcagcccgagagcaacatcctggacatcgacctgcggcccgcctccgcctggaccctctacgccgtggcgaccaccttcgtcacgcccatgctgcgccacagcatcgagaacagctccgtgaacgtgagcctgaccgccatcgccaaccaggccaccgtcctcatggggctgggcaaggggtgggccctggcgaagatggacatcggcgtgccgctcctgggcatcgggtgctactcccaggtgaaccccatcaccctgacgggcgccctcctgctgctcgggggccactacgccatcatcgggcccggcctgcaggccaaggccacccgggaggcgcagaagcgcgccgcccccggcatcatgaagaacccgaccgtcgacgggatcaccgtgatcgacctggaccccatcccctacgaccccaagttcgagaagcagctcggccaggtgatgctgctgatcctctgcgtcacccaggtgctgatgatgcggaccacctgggccctgtgcgaggcgctcaccctggccacggggccgatcagcaccctgtgggagggcaaccccggccgcttctggaacaccaccatcgccgtgtccatggccaacatcttccgcgggagctacctcgccggcgcggggctgctgttctccatcatgaagaacacgaccaacacccggcgcggcaccgggaacatgggcgagacgctcggcgagaagtggaagtcccggctgaacgccctggggaagtccgagttccagatctacaagaagtccggcatccaggaggtcgaccgcaccctcgccaaggaggggatcaagcggggcgagaccgaccaccacgccgtgtcccgcgggagcgccaagctgcggtggttcgtggagcgcaacatggtcacccccgagggcaaggtggtggacctgggctgcgcgcgcggcgggtggtcctactactgcgggggcctcaagaacgtccgcgaggtgaaggggctgacgaagggcggccccgggcacgaggagccgatccccatgagcacctacggctggaacctggtgcggctccagtccggggtcgacgtgttcttcatcccgcccgagaagtgcgacaccctgctgtgcgacatcggcgagagctcccccaaccccaccgtggaggccgggcgcacgctccgggtcctgaacctggtggagaactggctcaacaacaacacccagttctgcatcaaggtgctgaacccctacatgcccagcgtcatcgagaagatggaggccctgcagcgcaagtacggcggcgccctggtgcggaaccccctctcccgcaacagcacccacgagatgtactgggtgagcaacgcctccgggaacatcgtcagctccgtgaacatgatcagccggatgctgatcaaccgcttcaccatgcggcacaagaaggcgacctacgagcccgacgtggacctgggctccgggacgcgcaacatcggcatcgagagcgagatccccaacctcgacatcatcggcaagcgcatcgagaagatcaagcaggagcacgagacctcctggcactacgaccaggaccacccgtacaagacctgggcctaccacgggagctacgagaccaagcagacgggctccgccagctccatggtcaacggggtggtgcggctgctgaccaagccctgggacgtcctccccaccgtgacccagatggccatgacggacaccacccccttcggccagcagcgcgtgttcaaggagaaggtcgacacccggacgcaggacccgaaggaggggaccaagaagctgatgaagatcaccgcggagtggctgtggaaggagctcggcaagaagaagacgccccggatgtgcacgcgggaggagttcacccgcaaggtgcggagcaacgccgccctgggcgccatcttcaccgacgagaacaagtggaagtccgcccgcgaggcggtggaggacagccggttctgggagctggtcgacaaggagcgcaacctccacctggaggggaagtgcgagacctgcgtgtacaacatgatgggcaagcgggagaagaagctgggggagttcggcaaggccaaggcctcccgcgccatctggtacatgtggctcggggcccggttcctggagttcgaggcgctgggcttcctcaacgaggaccactggttcagccgcgagaactccctgagcggcgtggagggggagggcctgcacaagctcgggtacatcctgcgggacgtctccaagaaggagggcggggccatgtacgccgacgacacggccggctgggacacccgcatcaccctggaggacctcaagaacgaggagatggtgaccaaccacatggagggcgagcacaagaagctggccgaggcgatcttcaagctgacgtaccagaacaaggtcgtgcgggtgcagcgccccacgccccgggggaccgtcatggacatcatcagccgccgggaccagcgcggcagcggccaggtggccacctacggcctcaacacgttcaccaacatggaggcccagctgatccgccagatggagggcgagggggtgttcaagaacatccagcacctgaccgtcaccgaggaggtggccgtgcagaactggctcgcgcgggtcggccgcgagcggctgccgcgcatggccatctccggggacgactgcgtggtgaagcccctggacgcccggttcgccaacgccctcacggcgctgaacgccatgggcaagatccgcaaggacatccagcagtgggagcccagcaaggggtggaacgactggacccaggtccccttctgctcccaccacttccacgagctgatcatgaaggacggccgggtgctcgtggtcccgtgccgcaaccaggacgagctgatcggccgggcccgcatcagccagggggccggctggtccctgcgggagaccgcctgcctcggcaagagctacgcgcagatgtggtccctgatgtacttccaccgccgggacctgcgcctcgccgccaacgccatctgcagcgccgtgccctcccactgggtgcccaccagccggacgacctggtccatccacgcgaagcacgagtggatgaccaccgaggacatgctgaccgtctggaacaaggtgtggatccgcgagaacccctggatggaggacaagacgccggtggagagctgggaggagatcccctacctgggcaagcgggaggaccagtggtgcgggtccctcatcggcctgaccagccgcgccacctgggccaagaacatccaggccgccatcaaccaggtccggtccctgatcggcaacgaggagtacaccgactacatgcccagcatgaagcgcttccgccgggaggaggaggaggcgggggtgctctggtga

SEQ ID NO: 9516 - RNA, 9876 nt, synthetic construct
  misc_feature 1..9876: note = derived and/or modified CDS sequence (opt1) from DENV-2__FJ024454__SS-prME
  source 1..9876: mol_type = other RNA
agcgcggggatgatcatcatgctgatccccaccgtgatggccttccacctcaccacccggaacggggagccgcacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggccccgtcaccatggagtgcagcccccggacgggcctcgacttcaacgagatggtgctgctgcagatggagaacaaggcctggctcgtgcaccgccagtggttcctggacctgcccctcccgtggctgcccggggccgacaagcaggagtccaactggatccagaaggagaccctggtcaccttcaagaacccccacgccaagaagcaggacgtggtcgtgctcggcagccaggagggggcgatgcacaccgccctgacgggcgccaccgagatccagatgagctccgggaacctcctgttcaccggccacctgaagtgccggctgcgcatggacaagctccagctgaagggcatgagctactccatgtgcaccgggaagttcaaggtggtcaaggagatcgccgagacgcagcacggcaccatcgtgatccgggtgcagtacgagggggacggcagcccctgcaagatcccgttcgagatcatggacctggagaagcgctacgtcctcggccggctgatcaccgtgaaccccatcgtgaccgagaaggactcccccgtcaacatcgaggccgagcccccgttcggggacagctacatcatcatcggcgtggagcccgggcagctgaagctcaactggttcaagaagggctccagcatcgggcagatgttcgagacgaccatgcgcggcgcgaagcgcatggccatcctgggcgacaccgcctgggacttcgggtccctgggcggggtgttcaccagcatcggcaaggccctccaccaggtcttcggggccatctacggcgcggccttctccggcgtgagctggacgatgaagatcctgatcggggtgatcatcacctggatcggcatgaactcccggagcacctccctgagcgtctccctggtgctcgtggggatcgtcaccctgtacctgggcgtgatggtgcaggccgacagcgggtgcgtcgtgtcctggaagaacaaggagctcaagtgcggcagcggcatcttcatcacggacaacgtgcacacctggaccgagcagtacaagttccagcccgagagcccctccaagctggccagcgcgatccagaaggcccaggaggaggggatctgcggcatccgctccgtcacccggctggagaacctcatgtggaagcagatcacgccggagctgaaccacatcctggccgagaacgaggtgaagctcaccatcatgaccggggacatcaagggcatcatgcaggccgggaagcgcagcctgcggccccagcccaccgagctgaagtactcctggaagacgtggggcaaggccaagatgctcagcaccgagtcctacaaccagaccttcctgatcgacggcccggagaccgcggagtgccccaacacgaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacctggaagatcgagaaggccagcttcatcgaggtgaagaactgccactggcccaagtcccacacgctgtggagcaacggcgtcctggagtccgagatgatcatccccaagaacctcgccggcccggtgagccagcacaactaccgccccgggtaccacacccagatcgcgggcccctggcacctggggaagctggagatggacttcgacttctgcgacggcaccaccgtgatcgtcaccgaggactgcgggaaccggggcccctccctccgcacgaccaccgccagcggcaagctgatcaccgagtggtgctgccggagctgcacgctgccgcccctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggaccaagcacgcgatcctcctggtcgccgtgtccttcgtgacgctgatcaccggcaacatgagcttcaaggacctcgggcgggtcgtggtgatggtcggcgccaccatggccgacgacatcgggatgggcgtgacctacctggccctgctcgcggccttcaaggtgcgccccacgttcgccgccggcctgctgctccggaagctgacctccaaggagctgatgatgaccaccatcgggatcgtcctcctgagccagtccacgatcccggagaccgtgctggagctcaccgacgccctggcgctgggcatgatggtgctcaagatcgtccgcaacatggagaagtaccagctggccgtgaccatcatggccatcctgtgcgtccccaacgccgtgatcctccagaacgcctggaaggtgagctgcacgatcctggcggtcgtgtccgtgagccccctgctcctgacctccagccagcagaagaccgactggatccccctggccctcaccatcaaggggctgaacccgacggccatcttcctgaccaccctctcccgcaccaacaagaagcggagctggcccctgaacgaggccatcatggcggtcggcatggtgtccatcctggccagctccctcctgaagaacgacatccccatgacgggccccctggtggccgggggcctcctgaccgtctgctacgtgctgaccgggcgcagcgccgacctcgagctggagcgggccaccgacgtgaagtgggaggaccaggcggagatctccggcagcagcccgatcctgtccatcacgatcagcgaggacgggtccatgagcatcaagaacgaggaggaggagcagaccctcaccatcctgatccgcaccggcctgctcgtcatctccggcctgttccccatcagcatccccatcacggccgccgcctggtacctgtgggaggtgaagaagcagcgggccggggtgctctgggacgtcccctccccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccgtcctgggccgacgtgaagaaggacctgatcagctacggcgggggctggaagctggagggcgagtggaaggagggggaggaggtgcaggtcctcgcgctggagcccggcaagaacccccgggccgtgcagaccaagcccgggctgttcaagacgaacaccggcaccatcggggccgtgtccctcgacttcagcccgggcacctccggcagccccatcatcgacaagaaggggaaggtcgtgggcctgtacgggaacggcgtggtcacgcgctccggcgcctacgtgagcgccatcgcgcagaccgagaagtccatcgagaacaaccccgagatcgaggacgacatcttccggaagcgccggctgaccatcatggacctgcaccccggggccggcaagaccaagcgctacctcccggccatcgtgcgggaggccatcaagcgcgggctgcggacgctgatcctcgcgcccacccgcgtcgtggccgccgagatggaggaggccctgcggggcctgcccatccgctaccagacccccgccatccgggcggagcacaccgggcgcgagatcgtggacctcatgtgccacgccacgttcaccatgcgcctgctgagcccggtccgggtgcccaactacaacctcatcatcatggacgaggcccacttcaccgaccccgcctccatcgccgcgcgcggctacatcagcacccgggtggagatgggcgaggccgccgggatcttcatgacggccacgccgcccggcagccgcgaccccttcccccagtccaacgcccccatcatcgacgaggagcgggagatccccgagcgcagctggaactccgggcacgagtgggtcaccgacttcaagggcaagaccgtgtggttcgtgcccagcatcaaggcggggaacgacatcgccgcctgcctgcggaagaacggcaagaaggtcatccagctgtcccgcaagacgttcgacagcgagtacgtgaagacccggaccaacgactgggacttcgtggtcaccacggacatctccgagatgggcgccaacttcaaggcggagcgcgtgatcgacccccggcgctgcatgaagcccgtgatcctcaccgacggggaggagcgggtcatcctggccggcccgatgcccgtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacaccccggagggcatcatccccagcatgttcgagcccgagcgcgagaaggtggacgccatcgacggcgagtaccggctgcgcggggaggcccgcaagacgttcgtcgacctcatgcggcgcggcgacctgccggtgtggctggcctacaaggtggccgcggaggggatcaactacgccgaccggcgctggtgcttcgacggcatcaagaacaaccagatcctcgaggagaacgtcgaggtggagatctggcccaaggagggggagcggaagaagctgaagccccgctggctggacgcccggatctactccgaccccctcgccctgaaggagttcaaggagttcgccgcgggccgcaagagcctgaccctcaacctgatcaccgagatgggccggctgccgaccttcatgacgcagaagacccgcgacgccctcgacaacctggccgtcctgcacaccgccgaggccggcgggcgggcctacaaccacgccctctccgagctgcccgagaccctggagacgctcctgctgctcaccctgctggccaccgtgaccgggggcatcttcctcttcctgatgagcggccgcgggatcggcaagatgacgctggggatgtgctgcatcatcaccgcctccatcctcctgtggtacgcgcagatccagccccactggatcgccgccagcatcatcctggagttcttcctcatcgtgctgctgatccccgagccggagaagcagcggacgccccaggacaaccagctcacctacgtcgtgatcgccatcctgaccgtggtcgccgcgacgatggccaacgagatgggcttcctggagaagaccaagaaggacctcgggctgggctccatcgccacccagcagcccgagagcaacatcctggacatcgacctccgccccgcctccgcctggaccctgtacgcggtggccacgaccttcgtgaccccgatgctgcggcacagcatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaaccccatcaccctcaccgccgccctgctgctcctggtggcccactacgcgatcatcgggccgggcctgcaggccaaggccacccgcgaggcccagaagcgggccgcggccggcatcatgaagaaccccacggtcgacgggatcaccgtgatcgacctcgaccccatcccctacgacccgaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgcggtgagcatggccaacatcttccgcggctcctacctggccggcgccgggctcctcttcagcatcatgaagaacaccaccaacacgcggcgcggcaccgggaacatgggcgagaccctgggcgagaagtggaagtcccgcctgaacgccctcggcaagagcgagttccagatctacaagaagtccggcatccaggaggtcgaccggaccctggcgaaggaggggatcaagcgcggcgagacggaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggccgggccacgaggagcccatccccatgtccacctacgggtggaacctcgtgcgcctgcagagcggcgtcgacgtgttcttcatcccgcccgagaagtgcgacacgctgctctgcgacatcggggagtccagccccaaccccaccgtggaggccggccggaccctgcgcgtcctgaacctcgtggagaactggctgaacaacaacacccagttctgcatcaaggtgctgaacccgtacatgccctccgtcatcgagaagatggaggcgctgcagcggaagtacggcggggccctcgtgcgcaaccccctgagccggaacagcacgcacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacccggaacatcgggatcgagtccgagaccccgaacctggacatcatcggcaagcgcatcgagaagatcaagcaggagcacgagacgagctggcactacgaccaggaccacccctacaagacctgggcctaccacggctcctacgagaccaagcagaccgggagcgcgtccagcatggtcacgggcgtggtgcggctgctcaccaagccctgggacgtcctgcccaccgtgacccagatggccatgacggacaccaccccgttcgggcagcagcgcgtgttcaaggagaaggtcgacacccgcacgcaggaccccaaggaggccaccaagaagctgatgaagatcaccgccgagtggctctggaaggagctgggcaagaagaagacgccccggatgtgcacgcgcgaggagttcacccggaaggtgcgctccaacgccgcgctgggcgccatcttcaccgacgagaacaagtggaagtccgcccgggaggccgtggaggactcccgcttctgggagctcgtcgacaaggagcggaacctgcacctggaggggaagtgcgagacctgcgtgtacaacatgatgggcaagcgcgagaagaagctcggggagttcggcaaggccaaggggagccgggcgatctggtacatgtggctgggcgcccgcttcctggagttcgaggccctcggcttcctgaacgaggaccactggttctcccgggagaacagcctgtccggggtcgagggcgaggggctccacaagctgggctacatcctgcgcgacgtgagcaagaaggagggcggggccatgtacgcggacgacacggccggctgggacacccggatcaccctcgaggacctgaagaacgaggagatggtgaccaaccacatggagggggagcacaagaagctggccgaggccatcttcaagctcacgtaccagaacaaggtcgtgcgcgtgcagcggcccaccccgcgcggcaccgtcatggacatcatcagccggcgcgaccagcgggggtccggccaggtggggacctacggcctgaacacgttcaccaacatggaggcccagctgatccgccagatggagggcgagggggtgttcaagaacatccagcacctccccgtcaccgaggaggtggcggtgcagaactggctggcccgggtcggccgcgagcgcctgagccggatgcccatctccggggacgactgcgtggtgaagcccctcgacgcccgcttcccgaccgccctgacgcccctgaacgacatgggcaagatccggaaggacatccaccagtgggaccccagcaagggctggaacgactggacccaggtccccttctgctcccaccacttccacgagctcatcatgaaggacgggcgcgtgctggtggtcccgtgccggaaccaggacgacctgatcgcccgcgcgcggatcagccagggccccgggtggtccctccgcgagaccgcctgcctgggcaagagctacgcccagatgtggtccctgatgtacttccaccggcgcgacctccggctggccgccaacgcgatctgcagcgccgtgccctcccactgggtgcccaccagccgcacgacctggtccatccacgccaagcacgagtggatgaccaccgaggacatgctgaccgtctggaaccgggtgtggatccgcgagaacccgtggatggaggacaagacgcccgtggagagctgggaggagatcccctacctcgggaagcgggaggaccagtggtgcggctccctgatcggcctgaccagccgcgccacctgggccaagaacatccaggtcgcgatcaaccaggtgcggtccctcatcgggaacgaggagtacaccgactacatgccgagcatgaagcgcttccggcgcgaggaggaggaggccggcgtgctgtggtga

SEQ ID NO: 9517 - RNA, 9876 nt, synthetic construct
  misc_feature 1..9876: note = derived and/or modified CDS sequence (opt1) from DENV-2__FJ205878__SS-prME
  source 1..9876: mol_type = other RNA
agcgccgggatgatcatcatgctgatccccaccgtcaccgccttccacctcaccacccggaacggggagccccacatgatcgtcggcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccacgggcgagcaccgccgggagaagcgcagcgtcgccctggtgccccacgtggggatgggcctcgagacccggaccgagacctggatgtccagcgagggggcctggaagcacgcccagcgcatcgagacgtggatcctgcggcacccgggcttcaccatcatggccgcgatcctggcctacaccatcgggaccacgcacttccagcgcgtcctcatcttcatcctgctgaccgccgtggccccctccatgaccatgcggtgcatcggcatcagcaaccgcgacttcgtggagggcgtctccgggggcagctgggtggacatcgtgctcgagcacgggtcctgcgtcaccacgatggcgaagaacaagcccaccctggacttcgagctgatcaagaccgaggccaagcagcccgccaccctccggaagtactgcatcgaggccaagctgacgaacaccaccaccgagagccgctgccccacgcagggcgagccctccctgaaggaggagcaggacaagcggttcgtgtgcaagcacagcatggtggaccgcggctgggggaacggctgcggcctgttcggcaagggcgggatcgtgacctgcgccatgttcacgtgcaagaagaacatggagggcaagatcgtgcagcccgagaacctggagtacaccatcgtggtcacgccccactccggggaggagcacgcggtgggcaacgacaccgggaagcacggccaggagatcaaggtgaccccgcagagctccatcaccgaggccgagctgaccgggtacggcacggtcaccatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcacgttcaagaacccccacgccaagaagcaggacgtggtcgtgctcggcagccaggagggggcgatgcacaccgccctgaccggcgccaccgagatccagatgagctccgggaacctcctgttcacgggccacctgaagtgccggctgcgcatggacaagctccagctgaagggcatgagctactccatgtgcaccgggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcacggtgaacccgatcgtgaccgagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacacggcctgggacttcgggtccctgggcggggtgttcaccagcatcggcaaggccctccaccaggtcttcggggccatctacggcgcggccttctccggcgtgagctggaccatgaagatcctgatcggggtgatcatcacctggatcggcatgaactcccggagcacgtccctgagcgtctccctggtgctcgtggggatcgtcaccctgtacctgggcgtgatggtgcaggccgacagcgggtgcgtcgtgtcctggaagaacaaggagctcaagtgcggcagcggcatcttcatcaccgacaacgtgcacacctggacggagcagtacaagttccagcccgagagcccctccaagctggccagcgcgatccagaaggcccaggaggaggggatctgcggcatccgctccgtcacccggctggagaacctcatgtggaagcagatcacccccgagctgaaccacatcctggccgagaacgaggtgaagctcaccatcatgacgggggacatcaagggcatcatgcaggccgggaagcgcagcctgcggccgcagcccaccgagctgaagtactcctggaagacctggggcaaggccaagatgctcagcaccgagtcctacaaccagacgttcctgatcgacggccccgagaccgcggagtgcccgaacaccaaccgcgcctggaacagcctggaggtggaggactacgggttcggcgtcttcaccacgaacatctggctcaagctgaaggagaagcaggacgccttctgcgactccaagctgatgagcgccgccatcaaggacaaccgggcggtgcacgccgacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccacggtgatcgtcaccgaggactgcgggaaccggggcccctccctccgcaccaccacggccagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgcgatcctcctggtcgccgtgtccttcgtgaccctgatcaccggcaacatgagcttcaaggacctcgggcgggtcgtggtgatggtcggcgccacgatgaccgacgacatcgggatgggcgtgacctacctggccctgctcgccgcgttcaaggtgcgccccaccttcgccgccggcctgctgctccggaagctgacgtccaaggagctgatgatgaccaccatcgggatcgtcctcctgagccagtccaccatccccgagacggtgctggagctcaccgacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacgtccagccagcagaagaccgactggatccccctggcgctcaccatcaaggggctgaaccccaccgccatcttcctgacgaccctctcccgcaccaacaagaagcggagctggccgctgaacgaggccatcatggccgtcggcatggtgtccatcctggcgagctccctcctgaagaacgacatccccatgaccggccccctggtggccgggggcctcctgacggtctgctacgtgctgaccgggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagacgctcaccatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtaccgggaggggaccttccacacgatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgcggtgcagaccaagcccgggctgttcaagaccaacacgggcaccatcggggccgtgtccctcgacttcagccccggcacctccggcagccccatcatcgacaagaaggggaaggtcgtgggcctgtacgggaacggcgtggtcacccggtccggcgcctacgtgagcgccatcgcccagacggagaagtccatcgaggacaaccccgagatcgaggacgacatcttccgcaagcggcgcctgaccatcatggacctgcaccccggggcgggcaagaccaagcggtacctccccgccatcgtgcgcgaggccatcaagcgggggctgcgcaccctgatcctcgccccgacgcgggtcgtggcggccgagatggaggaggccctgcgcggcctgcccatccggtaccagacccccgccatccgcgccgagcacaccgggcgcgagatcgtggacctcatgtgccacgcgaccttcacgatgcggctgctgagccccgtccgcgtgccgaactacaacctcatcatcatggacgaggcccacttcaccgaccccgcctccatcgccgcccggggctacatcagcacccgcgtggagatgggcgaggcggccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagaccgtgtggttcgtgccgagcatcaaggccgggaacgacatcgcggcctgcctgcgcaagaacggcaagaaggtcatccagctgtcccggaagaccttcgacagcgagtacgtgaagacgcgcaccaacgactgggacttcgtggtcaccaccgacatctccgagatgggcgccaacttcaaggccgagcgggtgatcgacccccgccggtgcatgaagcccgtgatcctcacggacggggaggagcgcgtcatcctggcgggccccatgccggtgacccacagctccgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgcgatcgacggcgagtaccgcctgcgcggggaggcccggaagaccttcgtcgacctcatgcgccggggcgacctgcccgtgtggctggcctacaaggtggccgccgaggggatcaactacgcggaccgccggtggtgcttcgacggcatcaagaacaaccagatcctcgaggagaacgtcgaggtggagatctggacgaaggagggggagcgcaagaagctgaagccgcggtggctggacgcccgcatctactccgaccccctcgccctgaaggagttcaaggagttcgccgccggccggaagtccctgaccctcaacctgatcaccgagatgggccgcctgcccaccttcatgacgcagaagacccgggacgcgctcgacaacctggccgtcctgcacaccgccgaggccgggggccgcgcgtacaaccacgccctctccgagctgcccgagaccctggagacgctcctgctgctcaccctgctggccaccgtgaccgggggcatcttcctcttcctgatgagcggccgggggatcggcaagatgaccctggggatgtgctgcatcatcacggcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgaccgtggtcgccgccacgatggcgaacgagatgggcttcctggagaagaccaagaaggacctcgggctgggctccatcgccacccagcagccggagagcaacatcctggacatcgacctccggcccgcctccgcctggaccctgtacgccgtggcgacgaccttcgtgacccccatgctgcgccacagcatcgagaacagctccgtcaacgtgagcctcaccgccatcgccaaccaggccacggtgctgatgggcctggggaagggctggcccctctccaagatggacatcggggtcccgctgctggccatcggctgctacagccaggtgaaccccatcaccctcaccgcggccctgctgctcctggtggcccactacgccatcatcgggcccggcctgcaggcgaaggccacccgggaggcccagaagcgcgccgccgcgggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaacccggggcgcttctggaacacgaccatcgccgtgagcatggcgaacatcttccggggctcctacctggccggcgccgggctcctcttcagcatcatgaagaacaccaccaacacgcgccgcggcaccgggaacatgggcgagaccctgggcgagaagtggaagtcccggctgaacgccctcggcaagagcgagttccagatctacaagaagtccggcatccaggaggtcgaccgcaccctggccaaggaggggatcaagcggggcgagacggaccaccacgcggtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacacgctgctctgcgacatcggggagtccagccccaacccgaccgtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcacgatgcggcacaagaaggccacctacgagcccgacgtggacctcgggagcggcacccgcaacatcgggaccgagtccgagatccccaacctggacatcatcggcaagcggatcgagaagatcaagcaggagcacgagacgagctggcactacgaccaggaccacccctacaagacctgggcctaccacggctcctacgagaccaagcagaccgggagcgcctccagcatggtcaacggcgtggtgcgcctgctcacgaagccgtgggacgtcctgcccatggtgacccagatggcgatgaccgacaccacgcccttcgggcagcagcgcgtgttcaaggagaaggtcgacacccggacccaggagcccaaggagggcaccaagaagctgatgaagatcacggccgagtggctctggaaggagctgggcaagaagaagaccccgcgcatgtgcacccgggaggagttcacccgcaaggtgcggtccaacgccgccctgggggccatcttcacggacgagaacaagtggaagtccgcgcgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgccgggtgggacacccgcatcacgctcgaggacctgaagaacgaggagatggtgaccaaccacatggagggcgagcacaagaagctggcggaggccatcttcaagctcacctaccagaacaaggtcgtgcgggtgcagcgccccacgccccgggggacggtcatggacatcatcagccgccgggaccagcgcggctccggccaggtggggacctacggcctgaacaccttcaccaacatggaggcccagctgatccggcagatggagggggagggcgtgttcaagaacatccagcacctcacggtcaccgaggaggtggccgtgaagaactggctggcccgcgtcgggcgcgagcggctgagccgcatggcgatctccggcgacgactgcgtggtgaagcccctcgacgaccggttcgccaacgccctgaccgccctgaacgacatgggcaagatccgcaaggacatccagcagtgggagccgagcaaggggtggaacgactggacccaggtccccttctgctcccaccacttccacgagctcatcatgaaggacggccgggtgctggtggtcccctgccgcaaccaggacgagctgatcgggcgggcccgcatcagccagggcgcggggtggtccctccgggagacggcctgcctgggcaagagctacgcccagatgtggtccctgatgtacttccaccgccgggacctccgcctggccgccaacgcgatctgcagcgccgtgccctcccactgggtgccgaccagccggaccacctggtccatccacgccaagcacgagtggatgaccacggaggacatgctgaccgtctggaaccgcgtgtggatccgggagaacccctggatggaggacaagacccccgtggagagctgggaggagatcccctacctcggcaagcgcgaggaccagtggtgcgggtccctgatcggcctgaccagccgggccacgtgggccaagaacatccaggcggccatcaaccaggtccgctccctcatcgggaacgaggagtacaccgactacatgccgagcatgaagcggttccgccgcgaggaggaggaggccggcgtgctgtggtga

SEQ ID NO: 9518 - RNA, 9876 nt, synthetic construct
  misc_feature 1..9876: note = derived and/or modified CDS sequence (opt1) from DENV-2__FJ205879__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcatctgcaagcacagcatggtggaccgcggctgggggaacggctgcggcctgttcggcaagggcgggatcgtgacgtgcgccatgttcacgtgcaagaagaacatggagggcaagatcgtccagcccgagaacctggagtacaccatcgtggtgacgccccactccggggaggagcacgcggtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcaggagtccaactggatccagaaggagaccctggtgaccttcaagaacccccacgccaagaagcaggacgtcgtggtcctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtggtggtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcaccaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtcgtgatcgccatcctgaccgtggtcgccgcgaccatggccaacgagatgggcttcctggagaagacgaagaaggacctcgggctgggctccatcgccacccagcagccggagagcaacatcctggacatcgacctccgccccgcctccgcctggaccctgtacgcggtggccaccacgttcgtgacccccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcacgctcaccgccgccctgctgctcctggtggcccactacgcgatcatcgggcccggcctgcaggccaaggccacccgcgaggcccagaagcgggccgcggccggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcaacccggggcggttctggaacaccacgatcgcggtgagcatggccaacatcttccgcggctcctacctggccggcgccgggctcctcttcagcatcatgaagaacaccaccaacccccggcgcggcaccgggaacatgggcgagacgctgggcgagaagtggaagtcccgcctgaacgccctcgggaagtccgagttccagatctacaagcggtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagccgatccccatgtccacctacgggtggaacctcgtgcggctgcagagcggcgtcgacgtgttcttcatcccgcccgagaagtgcgacaccctgctctgcgacatcggggagtccagcccgaaccccaccgtggaggccggccgcacgctgcgggtcctgaacctcgtggagaactggctgaacaacaacacccagttctgcatcaaggtgctgaacccctacatgccgtccgtcatcgagaagatggaggcgctgcagcgcaagtacggcggggccctcgtgcggaaccccctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccgtacaagacctgggcctaccacggctcctacgagaccaagcagacggggagcgcgtccagcatggtcaacggcgtggtgcgcctgctcaccaagccctgggacgtcctgcccaccgtgacccagatggccatgacggacaccacccccttcgggcagcagcgcgtgttcaaggagaaggtcgacacccggacgcaggagccgaaggagggcaccaagaagctgatgaagatcaccgccgagtggctctggaaggagctgggcaagaagaagacgccccggatgtgcacgcgggaggagttcacccgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacacggcggggtgggacacccgcatcaccctcgaggacctgaagaacgaggagatggtgaccaaccacatggagggcgagcacaagaagctggccgaggccatcttcaagctcacgtaccagaacaaggtcgtgcgggtgcagcgccccacgccccgggggaccgtcatggacatcatcagccgccgggaccagcgcggctccggccaggtggggacctacggcctgaacacgttcaccaacatggaggcccagctgatccggcagatggagggggagggcgtgttcaagaacatccagcacctcaccgtcaccgaggaggtggccgtgcagaactggctggcgcgcgtcgggcgcgagcggctgagccgcatggccatctccggcgacgactgcgtggtgaagccgctcgacgaccggttcgccaacgccctgacggccctgaacgacatgggcaagatccgcaaggacatccagcagtgggagcccagcaaggggtggaacgactggacccaggtccccttctgctcccaccacttccacgagctcatcatgaaggacggccgggtgctggtggtcccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtgccgtcccactgggtgcccaccagccggacgacctggtccatccacgccaagcacgagtggatgaccaccgaggacatgctgaccgtctggaaccgcgtgtggatccgggagaacccctggatggaggacaagacgcccgtggagagctgggaggagatcccgtacctcggcaagcgcgaggaccagtggtgcgggtccctgatcggcctgaccagccgggccacctgggcgaagaacatccaggccgccatcaaccaggtccgctccctcatcgggaacgaggagtacaccgactacatgcccagcatgaagcggttccgccgcgaggaggaggaggccggcgtgctgtggtga

SEQ ID NO: 9519 - RNA, 9876 nt, synthetic construct
  misc_feature 1..9876: note = derived and/or modified CDS sequence (opt1) from DENV-2__FJ390385__SS-prME
  source 1..9876: mol_type = other RNA
agcgccgggatgatcatcatgctgatccccaccgtgatggccttccacctcaccacccggaacggggagccccacatgatcgtggggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcggagcgtcgccctggtgccccacgtggggatgggcctcgagacccggaccgagacctggatgagcagcgagggggcctggaagcacgcccagcgcatcgagacctggatcctgcggcacccgggcttcaccatcatggccgcgatcctggcctacaccatcgggaccacccacttccagcgggtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgccacggagaaggactcccccgtgaacatcgaggcggagccgcccttcggggacagctacatcatcatcggcgtcgagccggggcagctgaagctcaactggttcaagaagggctccagcatcgggcagatgttcgagaccaccatgcgcggcgccaagcgcatggccatcctgggcgacaccgcctgggacttcgggtccctgggcggggtgttcacgagcatcggcaaggccctccaccaggtgttcggggcgatctacggcgccgccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggcgagcgccatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggcgaagatgctcagcaccgagtcctacaaccagaccttcctgatcgacggccccgagacggccgagtgcccgaacaccaaccgcgcctggaacagcctggaggtggaggactacgggttcggcgtgttcaccaccaacatctggctcaagctgaaggagaagcaggacgccttctgcgactccaagctgatgagcgccgcgatcaaggacaaccgggccgtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgcgggccccgtcagccagcacaactaccgcccggggtaccacacccagatcgccggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgccatcctcctggtggccgtctccttcgtgaccctgatcaccggcaacatgagcttcaaggacctcgggcgggtggtcgtgatggtgggcgccaccatggccgacgacatcgggatgggcgtcacgtacctggcgctgctcgccgccttcaaggtgcgccccaccttcgccgccggcctgctgctccggaagctgacctccaaggagctgatgatgaccacgatcgggatcgtgctcctgagccagtccaccatccccgagaccgtcctggagctcaccgacgcgctggccctgggcatgatggtgctcaagatcgtgcgcaacatggagaagtaccagctggccgtcacgatcatggccatcctgtgcgtgccgaacgccgtcatcctccagaacgcgtggaaggtggggtgcaccatcctggccgtggtcagcgtgagccccctgctcctgaccagctcccagcagaagaccgactggatccccctggccctcacgatcaagggcctgaaccccaccgccatcttcctgaccaccctcagccgcacgaacaagaagcggtcctggccgctgaacgaggcgatcatggccgtgggcatggtcagcatcctggcctccagcctcctgaagaacgacatccccatgaccgggcccctggtggccggcgggctcctgaccgtgtgctacgtcctgaccggccgctccgccgacctcgagctggagcgggcgacggacgtgaagtgggaggaccaggccgagatcagcgggtccagccccatcctgagcatcaccatctccgaggacggcagcatgtccatcaagaacgaggaggaggagcagaccctcaccatcctgatccgcacgggcctgctcgtgatcagcgggctgttcccgatctccatccccatcaccgccgccgcctggtacctgtgggaggtcaagaagcagcgggcgggcgtgctctgggacgtgccctccccgccgcccatggggaaggccgagctggaggacggcgcctaccgcatcaagcagaaggggatcctgggctactcccagatcggcgccggggtctacaaggagggcaccttccacaccatgtggcacgtgacccgcggggcggtgctcatgcacaagggcaagcgcatcgagcccagctgggcggacgtcaagaaggacctgatctcctacgggggcggctggaagctggagggggagtggaaggagggcgaggaggtccaggtgctcgccctggagcccgggaagaacccccgggccgtccagacgaagcccggcctgttcaagaccaacaccgggaccatcggcgccgtgagcctcgacttctcccccggcacgagcgggtcccccatcatcgacaagaagggcaaggtggtcgggctgtacggcaacggcgtggtgacccgcagcggggcctacgtctccgcgatcgcccagaccgagaagtccatcgaggacaaccccgagatcgaggacgacatcttccggaagcgccggctgaccatcatggacctgcaccccggcgccgggaagacgaagcgctacctccccgccatcgtgcgggaggcgatcaagcgcggcctgcggaccctgatcctcgccccgacccgcgtggtcgccgccgagatggaggaggccctgcgggggctgcccatccgctaccagacccccgcgatccggtccgagcacacgggccgcgagatcgtggacctcatgtgccacgccaccttcaccatgcgcctgctgagccccgtgcgggtcccgaactacaacctcatcatcatggacgaggcccacttcaccgaccccgcctccatcgccgcgcgcggctacatcagcacgcgggtggagatgggggaggccgccggcatcttcatgaccgccacgccgcccgggagccgcgacccgttcccccagtccaacgcccccatcatcgacgaggagcgggagatccccgagcgcagctggaactccggccacgagtgggtgaccgacttcaaggggaagacggtctggttcgtgccgagcatcaaggcgggcaacgacatcgccgcctgcctgcggaagaacggcaagaaggtgatccagctgtcccgcaagaccttcgacagcgagtacgtcaagacccggaccaacgactgggacttcgtggtgacgaccgacatctccgagatgggggccaacttcaaggcggagcgcgtcatcgacccccggcgctgcatgaagcccgtgatcctcaccgacggcgaggagcgggtgatcctggccgggcccatgccggtcacccacagctccgccgcccagcgccggggccgcatcgggcggaaccccaagaacgagaacgaccagtacatctacatgggcgagcccctggagaacgacgaggactgcgcccactggaaggaggcgaagatgctcctggacaacatcaacacgcccgagggcatcatcccgagcatgttcgagcccgagcgcgagaaggtggacgccatcgacggggagtaccggctgcgcggcgaggcccgcaagaccttcgtggacctcatgcggcgcggggacctgcccgtctggctggcctacaaggtggccgcggagggcatcaactacgccgaccggcgctggtgcttcgacgggatcaagaacaaccagatcctcgaggagaacgtggaggtcgagatctggaccaaggagggcgagcggaagaagctgaagccgcgctggctggacgcccggatctactccgaccccctcgccctgaaggagttcaaggagttcgccgcgggccgcaagagcctgaccctcaacctgatcacggagatggggcggctgcccaccttcatgacccagaagacccgcgacgccctcgacaacctggccgtgctgcacacggccgaggcgggcgggcgggcctacaaccacgccctctccgagctgcccgagaccctggagaccctcctgctgctcaccctgctggccacggtcaccggcggcatcttcctcttcctgatgagcgggcgcggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtggtcatcgccatcctgaccgtggtggccgcgaccatggccaacgagatggggttcctggagaagaccaagaaggacctcggcctgggctccatcgccacgcagcagccggagagcaacatcctggacatcgacctccgccccgcctccgcctggaccctgtacgcggtcgccaccaccttcgtgacgcccatgctgcggcacagcatcgagaacagctccgtgaacgtcagcctcaccgccatcgccaaccaggccaccgtgctgatggggctgggcaaggggtggcccctctccaagatggacatcggcgtgccgctgctggcgatcgggtgctacagccaggtcaaccccatcaccctcacggccgccctgctgctcctggtggcccactacgcgatcatcggccccggcctgcaggccaaggccacccgcgaggcccagaagcgggccgcggccgggatcatgaagaaccccaccgtggacggcatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacgggccccatctccaccctctgggaggggaacccgggccggttctggaacaccaccatcgcggtgagcatggccaacatcttccgcggctcctacctggccggggccggcctcctcttcagcatcatgaagaacacgaccaacacccggcgcgggaccggcaacatgggcgagacgctgggggagaagtggaagtcccgcctgaacgccctcggcaagagcgagttccagatctacaagcggtccgggatccaggaggtggaccgcaccctggcgaaggagggcatcaagcgcggggagaccgaccaccacgccgtcagccgcggctccgccaagctgcggtggttcgtggagcgcaacatggtgacccccgagggcaaggtcgtggacctcgggtgcggccgcggcgggtggagctactactgcgggggcctgaagaacgtgcgcgaggtcaagggcctgacgaagggcgggcccgggcacgaggagcccatcccgatgtccacctacggctggaacctcgtgcggctgcagagcggggtggacgtcttcttcatcccgcccgagaagtgcgacaccctgctctgcgacatcggcgagtccagccccaacccgaccgtggaggccggccgcacgctgcgggtgctgaacctcgtcgagaactggctgaacaacaacacccagttctgcatcaaggtgctgaacccctacatgccctccgtgatcgagaagatggaggcgctgcagcgcaagtacgggggcgccctcgtccggaacccgctgagccgcaacagcacccacgagatgtactgggtgtccaacgccagcgggaacatcgtgtccagcgtcaacatgatctcccggatgctgatcaaccgcttcaccatgcggcacaagaaggccacctacgagcccgacgtggacctcggcagcgggacgcgcaacatcggcaccgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcgtccagcatggtgaacggggtcgtgcgcctgctcaccaagccgtgggacgtgctgcccaccgtcacgcagatggccatgaccgacaccacccccttcggccagcagcgcgtgttcaaggagaaggtggacacgcggacccaggagcccaaggagggcaccaagaagctgatgaagatcaccgccgagtggctctggaaggagctggggaagaagaagacgccgcgcatgtgcacccgggaggagttcacccgcaaggtccggtccaacgccgccctgggcgcgatcttcaccgacgagaacaagtggaagtccgcccgcgaggccgtggaggactcccggttctgggagctcgtggacaaggagcgcaacctgcacctggaggggaagtgcgagacgtgcgtctacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgagaacagcctgtccggggtggagggcgaggggctccacaagctgggctacatcctgcgggacgtcagcaagaaggagggcggggccatgtacgccgacgacaccgcgggctgggacacccgcatcaccctcgaggacctgaagaacgaggagatggtgacgaaccacatgaagggggagcacaagaagctggccgaggccatcttcaagctcacctaccagaacaaggtggtccgggtgcagcgccccacgccccggggcaccgtgatggacatcatcagccgccgggaccagcgcgggtccggccaggtcggcacgtacgggctgaacaccttcaccaacatggaggcccagctgatccggcagatggagggcgagggggtgttcaagaacatccagcacctcaccgtgacggaggaggtcgccgtgcagaactggctggcgcgcgtgggccgcgagcggctgagccgcatggccatctccggcgacgactgcgtcgtgaagcccctcgacgaccggttcgccaacgccctgaccgccctgaacgacatggggaagatccgcaaggacatccagcagtgggagccgagcaagggctggaacgactggacccaggtgcccttctgctcccaccacttccacgagctcatcatgaaggacgggcgggtcctggtggtgccctgccgcaaccaggacgagctgatcggccgggcgcgcatcagccagggggccggctggtccctccgggagaccgcctgcctgggcaagagctacgcccagatgtggtccctgatgtacttccaccgccgggacctccgcctggccgcgaacgccatctgcagcgccgtcccctcccactgggtgccgacgagccggaccacctggtccatccacgccaagcacgagtggatgaccaccgaggacatgctgacggtgtggaaccgcgtctggatccgggagaacccctggatggaggacaagacccccgtggagagctgggaggagatcccctacctcgggaagcgcgaggaccagtggtgcggctccctgatcgggctgaccagccgggccacctgggcgaagaacatccaggccgccatcaaccaggtgcgctccctcatcggcaacgaggagtacacggactacatgccgagcatgaagcggttccgccgcgaggaggaggaggccggggtcctgtggtga

SEQ ID NO: 9520 - RNA, 9876 nt, synthetic construct
  misc_feature 1..9876: note = derived and/or modified CDS sequence (opt1) from DENV-2__FJ024458__SS-prME
  source 1..9876: mol_type = other RNA
agcgccgggatgatcatcatgctgatccccaccgtgatggccttccacctcaccacccggaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcggagcgtcgccctggtgccccacgtggggatgggcctcgagacgcggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggcgccggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggactactggatcgagtccgccctcaacgacacgtggaagatcgagaaggccagcttcatcgaggtgaagaactgccactgggccaagtcccacaccctgtggagcaacggggtcctggagtccgagatgatcatccccaagaacctcgcgggccccgtgagccagcacaactaccggctgggctaccacacccagatcgccgggccctggcacctgggcaagctcgagatggacttcgacttctgcgacgggaccaccgtgatcgtcacggaggactgcggcaaccgcgggccgtccctgcggaccaccaccgccagcggcaagctgatcacggagtggtgctgccgcagctgcaccctgccgcccctgcggtaccgcggcgaggacgggtgctggtacggcatggagatccggcccctgaaggagaaggaggagaacctcgtgaactccctggtgaccgccgggcacggccaggtcgacaacttcagcctgggggtgctcggcatggcgctgttcctggaggagatgctccgcacccgggtgggcacgaagcacgccatcctgctggtcgccgtgtccttcgtgaccctcatcaccgggaacatgagcttcaaggacctgggccgcgtcgtggtgatggtcggggccaccatggccgacgacatcggcatgggggtgacgtacctggcgctcctggccgccttcaaggtgcggccgaccttcgccgccggcctgctcctgcgcaagctgacctccaaggagctcatgatgaccacgatcggcatcgtcctgctgagccagtccaccatccccgagaccgtgctcgagctgaccgacgcgctggccctcgggatgatggtgctgaagatcgtccgcaacatggagaagtaccagctggccgtgacgatcatggccatcctctgcgtccccaacgccgtgatcctgcagaacgcgtggaaggtgagctgcaccatcctggccgtcgtgtccgtgagccccctcctgctgacctccagccagcagaagaccgactggatcccgctcgccctgacgatcaagggcctgaaccccaccgccatcttcctcaccaccctgtcccggacgaacaagaagcgcagctggcccctgaacgaggcgatcatggccgtcgggatggtgtccatcctcgccagctccctgctgaagaacgacatccccatgaccggcccgctcgtggccggcgggctgctgaccgtctgctacgtgctcaccggccggagcgccgacctggagctggagcgcgcgacggacgtgaagtgggaggaccaggccgagatctccgggagcagccccatcctctccatcaccatcagcgaggacggctccatgagcatcaagaacgaggaggaggagcagaccctgaccatcctgatccggacggggctcctggtcatctccggcctgttccccatcagcatccccatcaccgccgccgcctggtacctctgggaggtgaagaagcagcgcgcgggcgtgctgtgggacgtcccgagcccgccgcccatggggaaggccgagctggaggacggcgcctaccggatcaagcagaaggggatcctcggctacagccagatcggggccggcgtgtacaaggagggcaccttccacaccatgtggcacgtgacccgcggggccgtcctgatgcacaagggcaagcggatcgagccgtcctgggcggacgtgaagaaggacctgatcagctacgggggcgggtggaagctcgagggcgagtggaaggagggcgaggaggtgcaggtcctggccctggagcccgggaagaacccccgcgccgtgcagacgaagccgggcctcttcaagaccaacaccgggaccatcggcgccgtgtccctggacttcagccccgggacgtccggcagccccatcatcgacaagaagggcaaggtcgtggggctgtacggcaacggggtggtcacccggtccggcgcctacgtgagcgcgatcgcccagaccgagaagtccatcgaggacaaccccgagatcgaggacgacatcttccgcaagcggcgcctgaccatcatggacctccacccgggcgccgggaagacgaagcggtacctgcccgccatcgtgcgcgaggcgatcaagcggggcctgcgcaccctcatcctggcccccacccgggtcgtggccgccgagatggaggaggccctgcgcgggctccccatccggtaccagaccccggcgatccgcgccgagcacacgggccgcgagatcgtggacctgatgtgccacgccaccttcaccatgcggctgctcagccccgtccgcgtgcccaactacaacctgatcatcatggacgaggcccacttcaccgaccccgcctccatcgcggcccgggggtacatcagcacgcgcgtggagatgggcgaggccgccggcatcttcatgaccgccaccccgcccgggagccgggaccccttcccccagtccaacgcgccgatcatcgacgaggagcgcgagatccccgagcggagctggaactccggccacgagtgggtcaccgacttcaaggggaagacggtgtggttcgtgcccagcatcaaggccggcaacgacatcgccgcctgcctgcgcaagaacgggaagaaggtcatccagctctcccggaagaccttcgacagcgagtacgtgaagacccgcaccaacgactgggacttcgtggtcacgaccgacatctccgagatgggcgcgaacttcaaggccgagcgggtgatcgacccccgccggtgcatgaagccggtgatcctgaccgacggcgaggagcgcgtcatcctggccgggcccatgcccgtgacccacagctccgccgcccagcggcgcggccggatcgggcgcaaccccaagaacgagaacgaccagtacatctacatgggcgagccgctcgagaacgacgaggactgcgcgcactggaaggaggccaagatgctgctggacaacatcaacacgcccgaggggatcatccccagcatgttcgagcccgagcgggagaaggtggacgccatcgacggcgagtaccgcctccgcggcgaggcccggaagaccttcgtcgacctgatgcgccgcggggacctgccggtgtggctcgcctacaaggtggcggccgagggcatcaactacgccgaccgccggtggtgcttcgacgggatcaagaacaaccagatcctggaggagaacgtcgaggtggagatctggaccaaggagggcgagcgcaagaagctgaagccccggtggctcgacgcccgcatctactccgaccccctggccctgaaggagttcaaggagttcgcggccgggcgcaagagcctcaccctgaacctgatcacggagatgggccggctcccgaccttcatgacccagaagacccgggacgccctggacaacctggccgtcctccacacggcggaggccggcgggcgcgcctacaaccacgccctgtccgagctgcccgagaccctcgagaccctgctgctcctgaccctgctcgccacggtgaccggcgggatcttcctgttcctgatgagcggccggggcatcgggaagatgaccctcggcatgtgctgcatcatcaccgcgtccatcctgctgtggtacgcccagatccagccccactggatcgccgccagcatcatcctcgagttcttcctgatcgtgctgctcatccccgagccggagaagcagcgcacgccccaggacaaccagctgacgtacgtcgtgatcgccatcctgaccgtggtcgcggccaccatggccaacgagatggggttcctcgagaagaccaagaaggacttcggcctggggtccatcgccacgcagcagcccgagagcaacatcctggacatcgacctccggcccgcctccgcgtggaccctgtacgccgtggccaccaccttcgtgacgccgatgctgcgccacagcatcgagaacagctccgtcaacgtgagcctcaccgccatcgccaaccaggcgaccgtgctgatgggcctgggcaaggggtggcccctctccaagatggacatcggcgtccccctgctggccatcgggtgctacagccaggtgaaccccatcaccctcacggccgccctgctgctcctggtggcgcactacgccatcatcggcccggggctgcaggccaaggccacccgggaggcccagaagcgcgcggccgccggcatcatgaagaaccccaccgtcgacggcatcaccgtgatcgacctcgaccccatcccctacgacccgaagttcgagaagcagctgggccaggtgatgctgctcatcctgtgcgtcacccaggtgctgatgatgcggaccacctgggccctctgcgaggccctgaccctggcgacgggccccatctccaccctctgggaggggaaccccggccgcttctggaacaccaccatcgccgtgagcatggccaacatcttccgggggtcctacctggccggcgccggcctcctcttcagcatcatgaagaacacgaccaacacccgccgcgggaccggcaacatcggggagacgctgggcgagaagtggaagtcccggctgaacgcgctcggcaagagcgagttccagatctacaagaagtccgggatccaggaggtcgaccgcaccctggccaaggagggcatcaagcgcggggagaccgaccaccacgccgtgagccgcggctccgccaagctgcggtggttcgtggagcgcaacatggtcacccccgaggggaaggtggtggacctcggctgcggccgcggcgggtggagctactactgcgggggcctgaagaacgtccgcgaggtgaaggggctgacgaagggcggcccggggcacgaggagcccatccccatgtccacctacggctggaacctcgtgcggctgcagagcggggtcgacgtgttcttcatcccgcccgagaagtgcgacaccctgctctgcgacatcggcgagtccagccccaaccccaccgtggaggcggggcgcacgctgcgggtcctgaacctcgtggagaactggctgaacaacaacacccagttctgcatcaaggtgctgaacccctacatgccctccgtcatcgagaagatggaggccctgcagcgcaagtacggcggcgccctcgtgcggaaccccctgagccgcaacagcacccacgagatgtactgggtgtccaacgccagcgggaacatcgtctccagcgtgaacatgatctcccggatgctgatcaaccgcttcaccatgcggcacaagaaggccacctacgagcccgacgtggacctcggcagcgggacgcgcaacatcggcatcgagtccgagatcccgaacctggacatcatcgggaagcggatcgagaagatcaagcaggagcacgagaccagctggcactacgaccaggaccacccctacaagacctgggcgtaccacggctcctacgagaccaagcagacgggcagcgcctccagcatggtcaacggggtggtgcgcctgctcaccaagccctgggacgtcctgcccaccgtgacccagatggccatgacggacaccaccccgttcggccagcagcgcgtgttcaaggagaaggtcgacacccggacgcaggagcccaaggaggggaccaagaagctgatgaagatcaccgccgagtggctctggaaggagctgggcaagaagaagacgccccggatgtgcacgcgggaggagttcacccgcaaggtgcggtccaacgccgcgctgggcgccatcttcaccgacgagaacaagtggaagtccgcccgcgaggccgtggaggactcccggttctgggagctcgtcgacaaggagcgcaacctgcacctggaggggaagtgcgagacctgcgtgtacaacatgatgggcaagcgggagaagaagctcggggagttcggcaaggccaaggggagccgcgcgatctggtacatgtggctgggcgcccggttcctggagttcgaggccctcggcttcctgaacgaggaccactggttctcccgcgagaacagcctgtccggggtcgagggcgaggggctccacaagctgggctacatcctgcgggacgtgagcaagaaggagggcggggccatgtacgcggacgacacggccggctgggacacccgcatcaccctcgaggacctgaagaacgaggagatggtgaccaaccacatggagggggagcacaagaagctggccgaggccatcttcaagctcacgtaccagaacaaggtcgtgcgggtgcagcgccccaccccgcggggcaccgtcatggacatcatcagccgccgggaccagcgcgggtccggccaggtggggacctacggcctgaacacgttcaccaacatggaggcccagctgatccggcagatggagggcgagggggtgttcaagaacatccagcacctcaccgtcaccgaggaggtggcggtgcagaactggctggcccgcgtcggccgcgagcggctgagccgcatggccatctccggggacgactgcgtggtgaagcccctcgacgaccggttcgccaacgccctgacggcgctgaacgacatgggcaagatccgcaaggacatccagcagtgggagcccagcaagggctggaacgactggacccaggtccccttctgctcccaccacttccacgagctcatcatgaaggacgggcgggtgctggtggtcccgtgccgcaaccaggacgagctgatcggccgggcccgcatcagccagggggccggctggtccctccgggagaccgcctgcctgggcaagagctacgcccagatgtggtccctgatgtacttccaccgccgggacctccgcctggcggccaacgccatctgcagcgccgtgccctcccactgggtgcccaccagccggacgacctggtccatccacgccaagcacgagtggatgaccaccgaggacatgctgaccgtctggaaccgcgtgtggatccgggagaacccctggatggaggacaagacgccggtggagagctgggaggagatcccctacctcggcaagcgcgaggaccagtggtgcggctccctgatcgggctgaccagccgggcgacctgggccaagaacatccaggccgccatcaaccaggtccgctccctcatcggcaacgaggagtacaccgactacatgcccagcatgaagcggttccgccgcgaggaggaggaggcgggggtgctgtggtga

SEQ ID NO: 9521 - RNA, 9876 nt, synthetic construct
  misc_feature 1..9876: note = derived and/or modified CDS sequence (opt1) from DENV-2__FJ205880__SS-prME
  source 1..9876: mol_type = other RNA
agcgcgggcatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgagcagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggcccccagcatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgcctcctgcgacagcaagctgatgtccgccgccatcaaggacaaccgggcggtgcacgccgacatggggtactggatcgagagcgccctcaacgacacgtggaagatcgagaaggcctccttcatcgaggtgaagaactgccactggcccaagagccacaccctgtggtccaacggcgtcctggagagcgagatgatcatccccaagaacctcgccggccccgtgtcccagcacaactaccgcccggggtaccacacccagatcgcgggcccctggcacctggggaagctggagatggacttcgacttctgcgacggcaccaccgtgatcgtcacggaggactgcgggaaccggggccccagcctccgcaccaccaccgccagcggcaagctgatcacggagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctcttcctggaggagatgctgaagacccgggtggggacgaagcacgcgatcctcctggtcgccgtgagcttcgtgaccctgatcaccggcaacatgtccttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgaccagcaaggagctgatgatgaccacgatcgggatcgtcctcctgtcccagagcaccatccccgagaccgtgctggagctcaccgacgccctggcgctgggcatgatggtgctcaagatcgtccggaacatggagaagtaccagctggccgtgacgatcatggccatcctgtgcgtcccgaacgccgtgatcctccagaacgcctggaaggtgtcctgcaccatcctggcggtcgtgagcgtgagccccctgctcctgaccagctcccagcagaagaccgactggatccccctggccctcacgatcaaggggctgaaccccaccgccatcttcctgaccaccctcagccgcacgaacaagaagcgctcctggccgctgaacgaggccatcatggcggtcggcatggtgagcatcctggcctccagcctcctgaagaacgacatccccatgaccggccccctggtggccgggggcctcctgaccgtctgctacgtgctgaccgggcggtccgccgacctcgagctggagcgcgccacggacgtgaagtgggaggaccaggcggagatcagcggcagctcccccatcctgagcatcaccatctccgaggacgggagcatgtccatcaagaacgaggaggaggagcagaccctcaccatcctgatccggacgggcctgctcgtcatcagcggcctgttcccgatctccatccccatcaccgccgccgcctggtacctgtgggaggtgaagaagcagcgcgccggggtgctctgggacgtcccctccccgccgcccatgggcaaggcggagctggaggacggggcctaccggatcaagcagaagggcatcctggggtactcccagatcggcgccggcgtgtacaaggaggggaccttccacaccatgtggcacgtgacccgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgagcctcgacttctcccccggcacgagcggctcccccatcatcgacaagaaggggaaggtcgtgggcctgtacgggaacggcgtggtcacccggagcggcgcctacgtgtccgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgggagatcgtggacctcatgtgccacgccaccttcaccatgcgcctgctgtcccccgtccgcgtgccgaactacaacctcatcatcatggacgaggcccacttcaccgaccccgccagcatcgccgcgcggggctacatcagcacgcgcgtggagatgggcgaggccgccgggatcttcatgaccgccacgccgcccggctcccgggacccgttcccccagagcaacgcccccatcatcgacgaggagcgcgagatccccgagcggtcctggaacagcgggcacgagtgggtcaccgacttcaagggcaagacggtgtggttcgtgccgtccatcaaggcggggaacgacatcgccgcctgcctgcgcaagaacggcaagaaggtcatccagctgagccggaagaccttcgactccgagtacgtgaagacccgcaccaacgactgggacttcgtggtcacgaccgacatcagcgagatgggcgccaacttcaaggcggagcgggtgatcgacccccgccggtgcatgaagcccgtgatcctcaccgacggggaggagcgcgtcatcctggccggccccatgccggtgacccactccagcgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgtccatgttcgagcccgagcgggagaaggtggacgccatcgacggcgagtaccgcctgcgcggggaggcccgcaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctcagcgagctgcccgagaccctggagaccctcctgctgctcaccctgctggccacggtgaccgggggcatcttcctcttcctgatgtccggccgggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggcagcatcgccacgcagcagccggagtccaacatcctggacatcgacctccggcccgccagcgcctggaccctgtacgcggtggccaccaccttcgtgacgcccatgctgcgccacagcatcgagaactccagcgtcaacgtgtccctcaccgccatcgccaaccaggccaccgtgctgatgggcctggggaagggctggcccctcagcaagatggacatcggggtcccgctgctggcgatcggctgctactcccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatcagcaccctctgggagggcaacccggggcgcttctggaacaccaccatcgcggtgtccatggccaacatcttccggggcagctacctggccggcgccgggctcctcttctccatcatgaagaacacgaccaacacccgccggggcaccgggaacatgggcgagacgctgggcgagaagtggaagtcccgcctgaacgccctcgggaagtccgagttccagatctacaagaagtccggcatccaggaggtcgaccgcaccctggcgaaggaggggatcaagcggggcgagaccgaccaccacgccgtgtcccgcgggagcgccaagctgcggtggttcgtggagcgcaacatggtcacccccgagggcaaggtggtggacctcggctgcgggcggggcgggtggtcctactactgcggcgggctgaagaacgtccgcgaggtgaagggcctgacgaagggcgggcccggccacgaggagcccatcccgatgagcacctacgggtggaacctcgtgcggctgcagtccggcgtcgacgtgttcttcatcccgcccgagaagtgcgacaccctgctctgcgacatcggggagagctcccccaacccgaccgtggaggccggccgcacgctgcgggtcctgaacctcgtggagaactggctgaacaacaacacccagttctgcatcaaggtgctgaacccctacatgcccagcgtcatcgagaagatggaggcgctgcagcgcaagtacggcggggccctcgtgcggaacccgctgagccgcaactccacccacgagatgtactgggtgagcaacgcctccggcaacatcgtcagctccgtgaacatgatcagccggatgctgatcaaccgcttcaccatgcggcacaagaaggccacctacgagcccgacgtggacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgcgagctccatggtcaacggcgtggtgcgcctgctcaccaagccgtgggacgtcctgcccaccgtgacccagatggccatgacggacaccacccccttcgggcagcagcgggtgttcaaggagaaggtcgacacccgcacgcaggagcccaaggagggcaccaagaagctgatgaagatcaccgccgagtggctctggaaggagctgggcaagaagaagaccccgcgcatgtgcacgcgggaggagttcacccgcaaggtgcggagcaacgccgccctgggggcgatcttcaccgacgagaacaagtggaagtccgcccgcgaggccgtggaggacagccggttctgggagctcgtcgacaaggagcgcaacctgcacctggagggcaagtgcgagacctgcgtgtacaacatgatggggaagcgggagaagaagctcggcgagttcgggaaggccaagggctcccgcgccatctggtacatgtggctgggcgcgcggttcctggagttcgaggccctcgggttcctgaacgaggaccactggttcagccgcgagaactccctgagcggcgtcgagggggagggcctccacaagctggggtacatcctgcgggacgtgagcaagaaggagggcggcgccatgtacgccgacgacacggcggggtgggacacccgcatcaccctcgaggacctgaagaacgaggagatggtgaccaaccacatggagggcgagcacaagaagctggccgaggccatcttcaagctcacgtaccagaacaaggtcgtgcgggtgcagcgccccacgccccgggggaccgtcatggacatcatctcccgccgggaccagcgcggcagcggccaggtggggacctacggcctgaacacgttcaccaacatggaggcccagctgatccggcagatggagggggagggcgtgttcaagaacatccagcacctcaccgtcaccgaggaggtggccgtgcagaactggctggcgcgcgtcgggcgggagcgcctgtcccgcatggccatcagcggcgacgactgcgtggtgaagcccctcgacgaccggttcgccaacgccctgacggccctgaacgacatgggcaagatccgcaaggacatccagcagtgggagccgtccaaggggtggaacgactggacccaggtccccttctgcagccaccacttccacgagctcatcatgaaggacggccgggtgctggtggtcccctgccgcaaccaggacgagctgatcgggcgggcgcgcatctcccagggcgccgggtggagcctccgggagaccgcctgcctgggcaagtcctacgcccagatgtggagcctgatgtacttccaccgccgggacctccgcctggccgcgaacgccatctgctccgccgtgcccagccactgggtgccgacctcccggacgacctggagcatccacgccaagcacgagtggatgaccaccgaggacatgctgaccgtctggaaccgcgtgtggatccgggagaacccctggatggaggacaagacgcccgtggagtcctgggaggagatcccctacctcggcaagcgcgaggaccagtggtgcgggagcctgatcggcctgacctcccgggccacctgggcgaagaacatccaggccgccatcaaccaggtccgcagcctcatcgggaacgaggagtacaccgactacatgccgagcatgaagcggttccgccgggaggaggaggaggccggcgtgctgtggtga

SEQ ID NO: 9522 - RNA, 9876 nt, synthetic construct
  misc_feature 1..9876: note = derived and/or modified CDS sequence (opt1) from DENV-2__FJ390387__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaaggtccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatgacggacgacatcgggatgggcgtgacctacctggccctgctcgccgcgttcaaggtccgccccaccttcgccgccggcctgctgctccggaagctgacctccaaggagctgatgatgacgaccatcgggatcgtgctcctgagccagtccaccatccccgagaccgtgctggagctcacggacgccctggccctgggcatgatggtcctcaagatcgtgcgcaacatggagaagtaccagctggcggtcaccatcatggccatcctgtgcgtgccgaacgccgtgatcctccagaacgcctggaaggtcagctgcaccatcctggccgtggtgtccgtcagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtgggcatggtgtccatcctggcgagctccctcctgaagaacgacatccccatgaccggccccctggtcgccgggggcctcctgaccgtgtgctacgtgctgacggggcgcagcgccgacctcgagctggagcgggccaccgacgtcaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtgatctccggcctgttcccgatcagcatccccatcaccgcggccgcctggtacctgtgggaggtgaagaagcagcgggccggggtcctctgggacgtgcccagcccgccgcccatgggcaaggccgagctggaggacggggcgtaccgcatcaagcagaagggcatcctggggtacagccagatcggcgccggcgtgtacaaggaggggaccttccacaccatgtggcacgtcacgcggggcgccgtgctcatgcacaaggggaagcgcatcgagccctcctgggccgacgtgaagaaggacctgatcagctacggcgggggctggaagctggagggcgagtggaaggagggggaggaggtccaggtgctcgccctggagcccggcaagaacccccgggcggtgcagaccaagcccgggctgttcaagaccaacaccggcacgatcggggccgtctccctcgacttcagccccggcacctccggcagccccatcatcgacaagaaggggaaggtggtgggcctgtacgggaacggcgtcgtgacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtccgggaggccatcaagcgcgggctgcggaccctgatcctcgccccgacccgcgtggtggcggccgagatggaggaggccctgcggggcctgcccatccgctaccagacgcccgccatccgggccgagcacaccgggcgcgagatcgtcgacctcatgtgccacgcgaccttcaccatgcgcctgctgagccccgtgcgggtgccgaactacaacctcatcatcatggacgaggcccacttcacggaccccgcctccatcgccgcccgcggctacatcagcacccgggtcgagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtgacggacttcaagggcaagaccgtgtggttcgtcccgagcatcaaggccgggaacgacatcgcggcctgcctgcggaagaacggcaagaaggtgatccagctgtcccgcaagaccttcgacagcgagtacgtgaagacccggacgaacgactgggacttcgtcgtgaccaccgacatctccgagatgggcgccaacttcaaggccgagcgcgtgatcgacccccggcgctgcatgaagcccgtcatcctcaccgacggggaggagcgggtgatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtcgacgcgatcgacggcgagtaccggctgcgcggggaggcccgcaagaccttcgtggacctcatgcggcgcggcgacctgcccgtgtggctggcctacaaggtcgccgccgaggggatcaactacgcggaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtgctgcacaccgccgaggccgggggccgggcgtacaaccacgccctctccgagctgcccgagaccctggagaccctcctgctgctcacgctgctggccaccgtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccaccatggcgaacgagatgggcttcctggagaagacgaagaaggacctcgggctgggctccatcgccacccagcagccggagagcaacatcctggacatcgacctccgccccgcctccgcctggaccctgtacgccgtggcgaccacgttcgtcacccccatgctgcggcacagcatcgagaacagctccgtgaacgtgagcctcaccgccatcgccaaccaggccaccgtcctgatgggcctggggaagggctggcccctctccaagatggacatcggggtgccgctgctggccatcggctgctacagccaggtgaaccccatcacgctcaccgcggccctgctgctcctggtcgcccactacgccatcatcgggcccggcctgcaggcgaaggccacccgcgaggcccagaagcgggccgccgcgggcatcatgaagaaccccaccgtggacgggatcacggtgatcgacctcgacccgatcccctacgaccccaagttcgagaagcagctgggccaggtcatgctgctcatcctgtgcgtgacccaggtgctgatgatgcgcaccacctgggccctctgcgaggccctgacgctggccaccgggcccatctccaccctctgggagggcaacccggggcggttctggaacaccacgatcgccgtcagcatggcgaacatcttccgcggctcctacctggccggcgccgggctcctcttcagcatcatgaagaacaccaccaacacccggcgcggcacggggaacatgggcgagaccctgggcgagaagtggaagtcccgcctgaacgccctcgggaagtccgagttccagatctacaagaagtccggcatccaggaggtggaccggaccctggccaaggaggggatcaagcgcggcgagaccgaccaccacgcggtgagccgggggtccgccaagctgcgctggttcgtcgagcggaacatggtgacgcccgagggcaaggtggtcgacctcggctgcgggcgcggcgggtggagctactactgcggcgggctgaagaacgtgcgggaggtgaagggcctgaccaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgacggtcgaggccggccggaccctgcgcgtgctgaacctcgtggagaactggctgaacaacaacacccagttctgcatcaaggtcctgaacccctacatgccctccgtgatcgagaagatggaggccctgcagcggaagtacggcggggcgctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacgtacgagcccgacgtcgacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtggtccggctgctcaccaagccgtgggacgtgctgcccaccgtgacgcagatggcgatgaccgacaccacccccttcgggcagcagcgcgtcttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtgcgctccaacgccgccctgggggccatcttcaccgacgagaacaagtggaagtccgcgcgggaggccgtcgaggactcccgcttctgggagctcgtggacaaggagcggaacctgcacctggagggcaagtgcgagacgtgcgtctacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtggagggggagggcctccacaagctggggtacatcctgcgcgacgtgagcaagaaggagggcggcgccatgtacgccgacgacaccgccgggtgggacacccggatcaccctcgaggacctgaagaacgaggagatggtcacgaaccacatggagggcgagcacaagaagctggcggaggccatcttcaagctcacctaccagaacaaggtggtgcgcgtccagcggcccacgccccgggggaccgtgatggacatcatcagccggcgcgaccagcggggctccggccaggtggggacgtacggcctgaacaccttcaccaacatggaggcccagctgatccgccagatggagggggagggcgtcttcaagaacatccagcacctcaccgtgacggaggaggtggccgtcaagaactggctggcccgggtggggcgcgagcgcctgagccggatggcgatctccggcgacgactgcgtggtcaagcccctcgacgaccgcttcgccaacgccctgaccgccctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctggtggggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtcccctcccactgggtgccgacgagccgcaccacctggtccatccacgccaagcacgagtggatgaccaccgaggacatgctgacggtgtggaaccgggtctggatccgcgagaacccctggatggaggacaagacccccgtggagagctgggaggagatcccctacctcggcaagcgggaggaccagtggtgcgggtccctgatcggcctgaccagccgcgccacctgggccaagaacatccaggcggccatcaaccaggtgcggtccctcatcgggaacgaggagtacacggactacatgccgagcatgaagcgcttccggcgcgaggaggaggaggccggcgtcctgtggtga

SEQ ID NO: 9523 - RNA, 9876 nt, synthetic construct
  misc_feature 1..9876: note = derived and/or modified CDS sequence (opt1) from DENV-2__FJ024461__SS-prME
  source 1..9876: mol_type = other RNA
agcgccgggatgatcatcatgctgatccccaccgtgatggccttccacctcaccacccggaacggggagccccacatgatcgtcgggatccaggagaaggggaagtccctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtgggcatgggcctcgagacccggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcctggggtaccacacccagatcgcgggcccgtggcacctggggaagctcgagatggacttcgacttctgcgacggcaccaccgtgatcgtcacggaggactgcgggaaccggggcccctccctgcgcaccaccaccgccagcggcaagctgatcacggagtggtgctgccggagctgcaccctgccgcccctgcgctaccgcggggaggacggctgctggtacgggatggagatccgcccgctgaaggagaaggaggagaacctcgtgaactccctggtgaccgccggccacgggcaggtcgacaacttcagcctgggcgtgctcggcatggccctgttcctggaggagatgctccggacccgcgtggggacgaagcacgcgatcctgctggtcgccgtgtccttcgtgaccctcatcaccggcaacatgagcttcaaggacctggggcgggtcgtggtgatggtcggcgccaccatggccgacgacatcgggatgggcgtgacgtacctggccctcctggcggccttcaaggtgcgccccaccttcgccgccggcctgctcctgcggaagctgacctccaaggagctcatgatgaccacgatcgggatcgtcctgctgagccagtccaccatccccgagaccgtgctcgagctgaccgacgccctggcgctcggcatgatggtgctgaagatcgtccgcaacatggagaagtaccagctggccgtgacgatcatggccatcctctgcgtccccaacgccgtgatcctgcagaacgcctggaaggtgagctgcaccatcctggcggtcgtgtccgtgagcccgctcctgctgacctccagccagcagaagaccgactggatccccctcgccctgacgatcaaggggctgaaccccaccgccatcttcctcaccaccctgtcccgcacgaacaagaagcggagctggcccctgaacgaggccatcatggcggtcggcatggtgtccatcctcgccagctccctgctgaagaacgacatcccgatgaccggccccctcgtggccgggggcctgctgaccgtctgctacgtgctcaccgggcgcagcgccgacctggagctggagcgggccacggacgtgaagtgggaggaccaggcggagatctccggcagcagccccatcctctccatcaccatcagcgaggacgggtccatgagcatcaagaacgaggaggaggagcagaccctgaccatcctgatccgcacgggcctcctggtcatctccggcctgttccccatcagcatcccgatcaccgccgccgcctggtacctctgggaggtgaagaagcagcgggccggggtgctgtgggacgtccccagcccgccgcccatgggcaaggcggagctggaggacggggcctaccgcatcaagcagaagggcatcctcgggtacagccagatcggcgccggcgtgtacaaggaggggaccttccacaccatgtggcacgtgacccggggcgccgtcctgatgcacaaggggaagcgcatcgagccctcctgggccgacgtgaagaaggacctgatcagctacggcgggggctggaagctcgagggcgagtggaaggagggggaggaggtgcaggtcctggcgctggagcccggcaagaacccccgggccgtgcagacgaagcccggcctcttcaagaccaacaccggcaccatcggggccgtgtccctggacttcagccccggcacgtccggcagccccatcatcgacaagaaggggaaggtcgtgggcctgtacgggaacggcgtggtcacccgctccggcgcctacgtgagcgccatcgcgcagaccgagaaggggatcgaggacaacccggagatcgaggacgacatcttccggaagcgccggctgaccatcatggacctccaccccggcgccgggaagacgaagcgctacctgcccgccatcgtgcgggaggccatcaagcgcggcctgcggaccctcatcctggcgcccacccgcgtcgtggccgccgagatggaggaggccctgcgggggctcccgatccgctaccagacccccgccatccgggcggagcacacgggccgcgagatcgtggacctgatgtgccacgccaccttcaccatgcgcctgctctcccccgtccgggtgcccaactacaacctgatcatcatggacgaggcccacttcaccgacccggccagcatcgccgcgcgcggctacatctccacgcgggtggagatgggggaggccgccggcatcttcatgaccgccacgccgcccgggagccgcgaccccttcccgcagagcaacgcccccatcatcgacgaggagcgggagatccccgagcgctcctggaacagcggccacgagtgggtcaccgacttcaaggggaagacggtgtggttcgtgccctccatcaaggcgggcaacgacatcgccgcctgcctgcggaagaacggcaagaaggtcatccagctcagccgcaagaccttcgactccgagtacgtgaagacccggaccaacgactgggacttcgtggtcacgaccgacatcagcgagatgggggccaacttcaaggcggagcgcgtgatcgacccgcggcgctgcatgaagcccgtgatcctgaccgacggcgaggagcgggtcatcctggccgggcccatgcccgtgacccactccagcgccgcccagcgccggggccgcatcgggcggaacccgaagaacgagaacgaccagtacatctacatgggcgagcccctcgagaacgacgaggactgcgcccactggaaggaggcgaagatgctgctggacaacatcaacacgcccgagggcatcatcccctccatgttcgagccggagcgcgagaaggtggacgccatcgacggggagtaccggctccgcggcgaggcccgcaagaccttcgtcgacctgatgcggcgcggggacctgcccgtgtggctcgcctacaaggtggccgcggagggcatcaactacgccgaccggcgctggtgcttcgacgggatcaagaacaaccagatcctggaggagaacgtcgaggtggagatctggaccaaggagggcgagcggaagaagctgaagccccgctggctcgacgcccggatctacagcgacccgctggccctgaaggagttcaaggagttcgccgcgggccgcaagtccctcaccctgaacctgatcacggagatggggcggctccccaccttcatgacccagaagacccgcgacgccctggacaacctggccgtcctccacacggccgaggcgggcgggcgggcctacaaccacgccctgagcgagctgcccgagaccctcgagaccctgctgctcctgaccctgctcgccacggtgaccggcggcatcttcctgttcctgatgtccgggcgcggcatcgggaagatgaccctcggcatgtgctgcatcatcaccgccagcatcctgctgtggtacgcgcagatccagccccactggatcgccgcctccatcatcctcgagttcttcctgatcgtgctgctcatcccggagcccgagaagcagcggacgccccaggacaaccagctgacgtacgtcgtgatcgccatcctgaccgtggtcgccgcgaccatggccaacgagatggggttcctcgagaagaccaagaaggacttcggcctgggcagcatcgccacgcagcagcccgagtccaacatcctggacatcgacctccgcccggccagcgcctggaccctgtacgcggtggccaccaccttcgtgacgcccatgctgcggcactccatcgagaacagcagcgtcaacgtgtccctcaccgccatcgccaaccaggccaccgtgctgatggggctgggcaaggggtggcccctcagcaagatggacatcggcgtccccctgctggcgatcgggtgctactcccaggtgaacccgatcaccctcacggccgccctgctgctcctggtggcccactacgcgatcatcggccccggcctgcaggccaaggccacccgcgaggcccagaagcgggccgcggccgggatcatgaagaaccccaccgtcgacggcatcaccgtgatcgacctcgaccccatcccgtacgaccccaagttcgagaagcagctgggccaggtgatgctgctcatcctgtgcgtcacccaggtgctgatgatgcgcaccacctgggccctctgcgaggccctgaccctggccacgggccccatcagcaccctctgggaggggaaccccggccggttctggaacaccaccatcgcggtgtccatggccaacatcttccgcggcagctacctggccggggccggcctcctcttctccatcatgaagaacacgaccaacacccggcgcgggaccggcaacatcggcgagacgctgggggagaagtggaagtcccgcctgaacgccctcggcaagagcgagttccagatctacaagaagtccgggatccaggaggtcgaccggaccctggcgaaggagggcatcaagcgcggggagaccgaccaccacgccgtgtcccggggcagcgccaagctgcgctggttcgtggagcggaacatggtcaccccggagggcaaggtggtggacctcgggtgcggccgcgggggctggtcctactactgcgggggcctgaagaacgtccgggaggtgaagggcctgacgaagggcgggcccgggcacgaggagcccatccccatgagcacctacggctggaacctcgtgcgcctgcagtccggggtcgacgtgttcttcatcccgcccgagaagtgcgacaccctgctctgcgacatcggcgagagctcccccaaccccaccgtggaggccggccggacgctgcgcgtcctgaacctcgtggagaactggctgaacaacaacacccagttctgcatcaaggtgctgaacccgtacatgcccagcgtcatcgagaagatggaggcgctgcagcggaagtacgggggcgccctcgtgcgcaaccccctgtcccggaacagcacccacgagatgtactgggtgagcaacgcctccgggaacatcgtcagctccgtgaacatgatcagccgcatgctgatcaaccggttcaccatgcgccacaagaaggccacctacgagccggacgtggacctcggctccgggacgcggaacatcggcatcgagagcgagatccccaacctggacatcatcggcaagcgcatcgagaagatcaagcaggagcacgagacctcctggcactacgaccaggaccacccctacaagacctgggcctaccacgggagctacgagaccaagcagacgggctccgcgagctccatggtcaacggggtggtgcggctgctcaccaagccctgggacgtcctgccgaccgtgacccagatggccatgacggacaccacccccttcggccagcagcgcgtgttcaaggagaaggtcgacacccgcacgcaggagcccaaggagggcaccaagaagctgatgaagatcaccgccgagtggctctggaaggagctggggaagaagaagacgccccggatgtgcacgcgcgaggagttcacccggaaggtgcgcagcaacgccgccctgggcgcgatcttcaccgacgagaacaagtggaagtccgcccgggaggccgtggaggacagccgcttctgggagctcgtcgacaaggagcggaacctgcacctggaggggaagtgcgagacctgcgtgtacaacatgatgggcaagcgcgagaagaagctcggggagttcggcaaggccaagggctcccgggccatctggtacatgtggctgggggcgcgcttcctggagttcgaggccctcggcttcctgaacgaggaccactggttcagccgggagaactccctgagcggggtcgagggcgaggggctccacaagctgggctacatcctgcgcgacgtgtccaagaaggagggcggggccatgtacgccgacgacacggcgggctgggacacccggatcaccctcgaggacctgaagaacgaggagatggtgaccaaccacatggagggggagcacaagaagctggccgaggccatcttcaagctcacgtaccagaacaaggtcgtgcgcgtgcagcggccgacgccccgcggcaccgtcatggacatcatcagccggcgcgaccagcgggggagcggccaggtgggcacctacgggctgaacaccttcaccaacatggaggcccagctgatccgccagatggagggcgagggggtgttcaagaacatccagcacctcaccgtcaccgaggaggtggccgtgcagaactggctggcgcgggtcggccgcgagcgcctgtcccggatggccatcagcggcgacgactgcgtggtgaagcccctcgacgaccgcttcgccaacgccctgacggccctgaacgacatggggaagatccggaaggacatccagcagtgggagccctccaagggctggaacgactggacccaggtcccgttctgcagccaccacttccacgagctcatcatgaaggacgggcgcgtgctggtggtcccctgccggaaccaggacgagctgatcggccgcgcgcggatctcccagggggccggctggagcctccgcgagaccgcctgcctgggcaagtcctacgcccagatgtggagcctgatgtacttccaccggcgcgacctccggctggccgcgaacgccatctgctccgccgtgcccagccactgggtgcccacctcccgcacgacctggagcatccacgccaagcacgagtggatgaccaccgaggacatgctgaccgtctggaaccgggtgtggatccgcgagaacccgtggatggaggacaagacgcccgtggagtcctgggaggagatcccctacctcgggaagcgggaggaccagtggtgcggcagcctgatcgggctgacctcccgcgccacctgggcgaagaacatccaggccgccatcaaccaggtccggagcctcatcggcaacgaggagtacaccgactacatgccctccatgaagcgcttccggcgcgaggaggaggaggccggggtgctgtggtga

SEQ ID NO: 9524 - RNA, 9876 nt, synthetic construct
  misc_feature 1..9876: note = derived and/or modified CDS sequence (opt1) from DENV-2__FJ373299__SS-prME
  source 1..9876: mol_type = other RNA
agcgcgggcatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcggagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactcccggctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgccggcgggatcaactacgccgaccgccggtggtgcttcgacgggatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatggggcgcctgcccaccttcatgacccagaagacccgggacgccctcgacaacctggccgtcctgcacacggccgaggcgggcgggcgcgcctacaaccacgccctctccgagctgcccgagaccctggagaccctcctgctgctcaccctgctggccacggtgaccggcggcatcttcctcttcctgatgagcgggcggggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatggggttcctggagaagaccaagaaggacctcggcctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatggggctgggcaaggggtggcccctctccaagatggacatcggcgtcccgctgctggcgatcgggtgctacagccaggtgaaccccatcaccctcacggccgccctgctgctcctggtggcccactacgcgatcatcggccccggcctgcaggccaaggccacccgggaggcccagaagcgcgccgcggccgggatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacgggccccatctccaccctctgggaggggaacccgggccgcttctggaacaccaccatcgcggtgagcatggccaacatcttccggggctcctacctggccggggccggcctcctcttcagcatcatgaagaacacgaccaacacccgccgcgggaccggcaacatgggcgagacgctgggggagaagtggaagtcccggctgaacgccctcggcaagagcgagttccagatctacaagaagtccgggatccaggaggtcgaccgcaccctggcgaaggagggcatcaagcgcggggagaccgaccaccacgccgtgagccgcggctccgccaagctgcggtggttcgtggagcgcaacatggtcacccccgagggcaaggtggtggacctcgggtgcggccgcggcgggtggagctactactgcggcgggctgaagaacgtccgcgaggtgaaggggctgacgaagggcgggcccgggcacgaggagcccatcccgatgtccacctacggctggaacctcgtgcggctgcagagcggggtcgacgtgttcttcatcccgcccgagaagtgcgacaccctgctctgcgacatcggcgagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacgggggcgccctcgtgcggaacccgctgagccgcaacagcacccacgagatgtactgggtgtccaacgccagcgggaacatcgtctccagcgtgaacatgatctcccggatgctgatcaaccgcttcaccatgcggcacaagaaggccacctacgagcccgacgtggacctcggcagcgggacgcgcaacatcggcatcgagtccgagacccccaacctggacatcatcggcaagcggatcgagaagatcaagcaggagcacgagaccagctggcactacgaccaggaccacccctacaagacctgggcctaccacgggtcctacgagacgaagcagaccggcagcgcgtccagcatggtcaacggggtggtgcgcctgctcaccaagccgtgggacgtcctgcccaccgtgacgcagatggccatgaccgacaccacccccttcggccagcagcgcgtgttcaaggagaaggtcgacacgcggacccaggagcccaaggagggcaccaagaagctgatgaagatcaccgccgagtggctctggaaggagctggggaagaagaagacgccgcgcatgtgcacccgggaggagttcacccgcaaggtgcggtccaacgccgccctgggcgcgatcttcaccgacgagaacaagtggaagtccgcccgcgaggccgtggaggactcccggttctgggagctcgtcgacaaggagcgcaacctgcacctggaggggaagtgcgagacgtgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgagaacagcctgtccggggtcgagggcgaggggctccacaagctgggctacatcctgcgggacgtgagcaagaaggagggcggggccatgtacgccgacgacaccgcgggctgggacacccgcatcaccctcgaggacctgaagaacgaggagatggtgacgaaccacatggagggggagcacaagaagctggccgaggccatcttcaagctcacctaccagaacaaggtcgtgcgggtgcagcgccccacgccccggggcaccgtcatggacatcatcagccgccgggaccagcgcgggtccggccaggtgggcacgtacgggctgaacaccttcaccaacatggaggcccagctgatccggcagatggagggcgagggggtgttcaagaacatccagcacctcaccgtcacggaggaggtggccgtgcagaactggctggcgcgcgtcggccgcgagcggctgagccgcatggccatctccggcgacgactgcgtggtgaagcccctcgacgaccggttcgccaacgccctgaccgccctgaacgacatggggaagatccgcaaggacatccagcagtgggagccgagcaagggctggaacgactggacccaggtccccttctgctcccaccacttccacgagctcatcatgaaggacgggcgggtgctggtggtcccctgccgcaaccaggacgagctgatcggccgggcgcgcatcagccagggggccggctggtccctccgggagaccgcctgcctgggcaagagctacgcccagatgtggtccctgatgtacttccaccgccgggacctccgcctggccgcgaacgccatctgcagcgccgtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctcgggaagcgcgaggaccagtggtgcggctccctgatcgggctgaccagccgggccacctgggcgaagaacatccaggtcgccatcaaccaggtgcgctccctcatcggcaacgaggagtacacggactacatgccgagcatgaagcggttccgccgcgaggaggaggaggccggggtgctgtggtga

SEQ ID NO: 9525 - RNA, 9876 nt, synthetic construct
  misc_feature 1..9876: note = derived and/or modified CDS sequence (opt1) from DENV-2__FJ410193__SS-prME
  source 1..9876: mol_type = other RNA
agcgccgggatgatcatcatgctgatccccaccgtgatggccttccacctcaccacccggaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcatctgcaagcacagcatggtggaccgcggctgggggaacggctgcggcctgttcggcaagggcgggatcgtgacgtgcgccatgttcacgtgcaagaagaacatggagggcaagatcgtccagcccgagaacctggagtacaccatcgtggtgacgccccactccggggaggagcacgcggtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcaggagtccaactggatccagaaggagaccctggtgaccttcaagaacccccacgccaagaagcaggacgtcgtggtcctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcgtgaccctgatcaccggcaacatgagcttcaaggacctcgggcgggtggtcgtgatggtgggcgccaccatggccgacgacatcgggatgggcgtcacgtacctggccctgctcgcggccttcaaggtgcgccccaccttcgccgccggcctgctgctccggaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtctccatcctggccagctccctcctgaagaacgacatccccatgaccggccccctggtggccgggggcctcctgaccgtgtgctacgtcctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtcaagaagcagcgggccggggtgctctgggacgtgcccagcccgccgcccatgggcaaggcggagctggaggacggggcctaccgcatcaagcagaagggcatcctggggtacagccagatcggcgccggcgtctacaaggaggggaccttccacaccatgtggcacgtgacccggggcgccgtgctcatgcacaaggggaagcgcatcgagccctcctgggccgacgtcaagaaggacctgatcagctacggcgggggctggaagctggagggcgagtggaaggagggggaggaggtccaggtgctcgcgctggagcccggcaagaacccccgggccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccgctccggcgcctacgtcagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtggtcgccgccgagatggaggaggccctgcggggcctgcccatccgctaccagacccccgccatccgggcggagcacacggggcgcgagatcgtggacctcatgtgccacgccaccttcaccatgcgcctgctgagccccgtgcgggtcccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtctggttcgtgccgagcatcaaggcggggaacgacatcgccgcctgcctgcggaagaacggcaagaaggtgatccagctgtcccgcaagaccttcgacagcgagtacgtcaagacccggaccaacgactgggacttcgtggtgacgaccgacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtcaccgggggcatcttcctcttcctgatgagcggccgcgggatcggcaagatgaccctggggatgtgctgcatcaccaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgaccgtggtggccgcgaccatggccaacgagatgggcttcctggagaagacgaagaaggacctcgggctgggctccatcgccacccagcagccggagagcaacatcctggacatcgacctccgccccgcctccgcctggaccctgtacgcggtcgccaccacgttcgtgacccccatgctgcggcacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcacgctcaccgccgccctgctgctcctggtggcccactacgcgatcatcgggcccggcctgcaggccaaggccacccgcgaggcccagaagcgggccgcggccggcatcatgaagaaccccaccgtggacgggatcacggtcatcgacctcgacccgatcccctacgaccccaagttcgagaagcagctgggccaggtgatgctgctcatcctgtgcgtgacccaggtcctgatgatgcgcaccacctgggccctctgcgaggccctgacgctggccaccgggcccatctccaccctctgggagggcaacccggggcggttctggaacaccacgatcgcggtgagcatggccaacatcttccgcggctcctacctggccggcgccgggctcctcttcagcatcatgaagaacaccaccaacacccggcgcggcacggggaacatgggcgagaccctgggcgagaagtggaagtcccgcctgaacgccctcgggaagtccgagttccagatctacaagcggtccggcatccaggaggtggaccgcaccctggcgaaggaggggatcaagcggggcgagaccgaccaccacgccgtcagccgcgggtccgccaagctgcggtggttcgtggagcgcaacatggtgacgcccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacctacgggtggaacctcgtgcggctgcagagcggcgtggacgtcttcttcatcccgcccgagaagtgcgacaccctgctctgcgacatcggggagtccagccccaacccgacggtggaggccggccgcaccctgcgggtgctgaacctcgtcgagaactggctgaacaacaacacccagttctgcatcaaggtgctgaacccctacatgccctccgtgatcgagaagatggaggcgctgcagcgcaagtacggcggggccctcgtccggaacccgctgagccgcaacagcacccacgagatgtactgggtgtccaacgccagcggcaacatcgtgtccagcgtcaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtgaacggcgtcgtgcgcctgctcaccaagccgtgggacgtgctgcccaccgtcacgcagatggccatgaccgacaccacccccttcgggcagcagcgcgtgttcaaggagaaggtggacacgcggacccaggagcccaaggagggcaccaagaagctgatgaagatcaccgccgagtggctctggaaggagctgggcaagaagaagacgccgcgcatgtgcacccgggaggagttcacccgcaaggtccggtccaacgccgccctgggggcgatcttcaccgacgagaacaagtggaagtccgcccgcgaggccgtggaggactcccggttctgggagctcgtggacaaggagcgcaacctgcacctggagggcaagtgcgagacgtgcgtctacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgccatgtacgccgacgacaccgcggggtgggacacccgcatcaccctcgaggacctgaagaacgaggagatggtgacgaaccacatggagggcgagcacaagaagctggccgaggccatcttcaagctcacctaccagaacaaggtggtccgggtgcagcgccccgcgccccgggggaccgtgatggacatcatcagccgccgggaccagcgcggctccgggcaggtcggcacctacggcctgaacacgttcaccaacatggaggcccagctgatccggcagatggagggggagggcgtgttcaagaacatccagcacctcaccgtgaccgaggaggtcgcggtgcagaactggctggcccgcgtggggcgcgagcggctgagccgcatggccatctccggcgacgactgcgtcgtgaagcccctcgacgaccggttcgccaacgccctgacggcgctgaacgacatgggcaagatccgcaaggacatccagcagtgggagccgagcaaggggtggaacgactggacccaggtgcccttctgctcccaccacttccacgagctcatcatgaaggacggccgggtcctggtggtgccctgccgcaaccaggacgagctgatcgggcgggcccgcatcagccagggcgccgggtggtccctccgggagaccgcctgcctgggcaagagctacgcccagatgtggtccctgatgtacttccaccgccgggacctccgcctggcggccaacgccatctgcagcgccgtcccctcccactgggtgccgaccagccggacgacctggtccatccacgccaagcacgagtggatgaccaccgaggacatgctgaccgtgtggaaccgcgtctggatccgggagaacccctggatggaggacaagacgcccgtggagagctgggaggagatcccctacctcggcaagcgcgaggaccagtggtgcgggtccctgatcggcctgaccagccgggcgacctgggccaagaacatccaggccgccatcaaccaggtgcgctccctcatcgggaacgaggagtacaccgactacatgccgagcatgaagcggttccgccgcgaggaggaggaggcgggcgtcctgtggtga

SEQ ID NO: 9526 - RNA, 9876 nt, synthetic construct
  misc_feature 1..9876: note = derived and/or modified CDS sequence (opt1) from DENV-2__FJ410195__SS-prME
  source 1..9876: mol_type = other RNA
agcgccgggatgatcatcatgctgatccccaccgtgatggccttccacctcaccacccggaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatcgtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatgaccatcctgtgcgtcccgaacgccgtgatcctccagaacgcctggaaggtgagctgcaccatcctggccgtcgtgtccgtgagccccctgctcctgacctccagccgccagaagacggactggatccccctggcgctcaccatcaaggggctgaaccccaccgccatcttcctgaccacgctctcccggaccaacaagaagcgcagctggccgctgaacgaggccatcatggccgtcggcatggtgtccatcctggcgagctccctcctgaagaacgacatccccatgaccggccccctggtggccgggggcctcctgaccgtctgctacgtgctgacggggcggagcgccgacctcgagctggagcgcgccaccgacgtgaagtgggaggaccaggccgagatctccggcagcagccccatcctgtccatcaccatcagcgaggacgggtccatgagcatcaagaacgaggaggaggagcagaccctcacgatcctgatccggaccggcctgctcgtcatctccggcctgctgccgatcagcatccccatcaccgcggccgcctggtacctctgggaggtgaagaagcagcgcgccggggtgctgtgggacgtccccagcccgccgcccatgggcaaggccgagctggaggacggggcgtaccggatcaagcagaagggcatcctcgggtacagccagatcggcgccggcgtgtacaaggaggggaccttccacaccatgtggcacgtgacgcgcggcgccgtcctgatgcacaaggggaagcggatcgagccctcctgggccgacgtgaagaaggacctgatcagctacggcgggggctggaagctcgagggcgagtggaaggagggggaggaggtgcaggtcctggccctggagcccggcaagaacccccgcgcggtgcagaccaagcccggcctcttcaagaccaacaccggcacgatcggggccgtgtccctggacttcagccccggcacctccggcagccccatcatcgacaagaaggggaaggtcgtgggcctgtacgggaacggcgtggtcacccggtccggcgcctacgtgagcgccatcgcccagaccgagaagtccatcgaggacaaccccgagatcgaggacgacatcttccgcaagcggcgcctgacgatcatggacctccaccccggggcgggcaagaccaagcggtacctgcccgccatcgtgcgcgaggccatcaagcgggggctgcgcaccctcatcctggccccgacccgggtcgtggcggccgagatggaggaggccctgcgcggcctccccatccggtaccagacgcccgccatccgcgccgagcacaccgggcgcgagatcgtggacctgatgtgccacgcgaccttcaccatgcggctgctcagccccgtccgcgtgccgaactacaacctgatcatcatggacgaggcccacttcacggaccccgcctccatcgccgcccggggctacatcagcacccgcgtggagatgggcgaggcggccgggatcttcatgaccgccacgccgcccggcagccgggacccgttcccccagtccaacgcccccatcatcgacgaggagcgcgagatccccgagcggagctggaactccgggcacgagtgggtcacggacttcaagggcaagaccgtgtggttcgtgccgagcatcaaggccgggaacgacatcgcggcctgcctgcgcaagaacggcaagaaggtcatccagctctcccggaagaccttcgacagcgagtacgtgaagacccgcacgaacgactgggacttcgtggtcaccaccgacatctccgagatgggcgccaacttcaaggccgagcgggtgatcgacccccgccggtgcatgaagcccgtgatcctgaccgacggggaggagcgcgtcatcctggcgggccccatgccggtgacgcacagctccgccgcccagcggcgcgggcggatcggccgcaaccccaagaacgagaacgaccagtacatctacatgggggagcccctcgagaacgacgaggactgcgcccactggaaggaggccaagatgctgctggacaacatcaacacccccgagggcatcatcccgagcatgttcgagcccgagcgggagaaggtggacgcgatcgacggcgagtaccgcctccgcggggaggcccggaagaccttcgtcgacctgatgcgccggggcgacctgcccgtgtggctcgcctacaaggtggccgccgaggggatcaactacgcggaccgccggtggtgcttcgacggcatcaagaacaaccagatcctggaggagaacgtcgaggtggagatctggaccaaggagggggagcgcaagaagctgaagccgcggtggctcgacgcccgcatctactccgaccccctggccctgaaggagttcaaggagttcgccgccggccggaagtccctcacgctgaacctgatcaccgagatgggccgcctccccaccttcatgacccagaagacgcgggacgcgctggacaacctggccgtcctccacaccgccgaggccgggggccgcgcgtacaaccacgccctgtccgagctgcccgagaccctcgagaccctgctgctcctgacgctgctcgccaccgtgaccgggggcatcttcctgttcctgatgagcggccgggggatcggcaagatgaccctcgggatgtgctgcatcatcaccgcctccatcctgctgtggtacgcccagatccagccgcactggatcgcggccagcatcatcctcgagttcttcctgatcgtgctgctcatccccgagcccgagaagcagcgcacgccccaggacaaccagctgacctacgtcgtgatcgccatcctgaccgtggtcgccgccaccatggcgaacgagatgggcttcctcgagaagacgaagaaggacctggggctgggctccatcgccacccagcagccggagagcaacatcctcgacatcgacctgcggcccgcctccgcctggaccctgtacgccgtggcgaccacgttcgtgacccccatgctccgccacagcatcgagaacagctccgtcaacgtgagcctgaccgccatcgccaaccaggccaccgtgctgatgggcctcgggaagggctggcccctgtccaagatggacatcggggtcccgctgctcgccatcggctgctacagccaggtgaaccccatcacgctgaccgcggccctgctcctgctggtggcccactacgccatcatcgggcccggcctccaggcgaaggccacccgggaggcccagaagcgcgccgccgcgggcatcatgaagaaccccaccgtcgacgggatcacggtgatcgacctggacccgatcccctacgaccccaagttcgagaagcagctgggccaggtgatgctcctgatcctgtgcgtcacccaggtgctcatgatgcggaccacctgggccctgtgcgaggccctgacgctcgccaccgggcccatctccaccctgtgggagggcaacccggggcgcttctggaacaccacgatcgccgtgagcatggcgaacatcttccggggctcctacctggccggcgccgggctcctgttcagcatcatgaagaacaccaccaacacccgccgcggcacggggaacatgggcgagaccctgggcgagaagtggaagtcccggctcaacgccctggggaagaacgagttccagatctacaagaagtccggcatccaggaggtcgaccgcaccctggccaaggaggggatcaagcggggcgagaccgaccaccacgcggtgtcccgcgggagcgccaagctccggtggttcgtggagcgcaacatggtcacgcccgagggcaaggtggtggacctgggctgcgggcggggcgggtggtcctactactgcggcgggctgaagaacgtccgcgaggtgaagggcctcaccaagggcgggcccggccacgaggagcccatcccgatgagcacctacgggtggaacctggtgcggctgcagtccggcgtcgacgtgttcttcatcccgcccgagaagtgcgacaccctcctgtgcgacatcggggagagctcccccaacccgacggtggaggccggccgcaccctgcgggtcctcaacctggtggagaactggctgaacaacaacacccagttctgcatcaaggtgctgaacccctacatgcccagcgtcatcgagaagatggaggccctccagcgcaagtacggcggggcgctggtgcggaacccgctgtcccgcaacagcacccacgagatgtactgggtgagcaacgcctccggcaacatcgtcagctccgtgaacatgatcagccggatgctcatcaaccgcttcaccatgcggcacaagaaggccacgtacgagcccgacgtggacctggggtccggcacccgcaacatcgggatcgagagcgagatccccaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtcaacggcgtggtgcgcctcctgaccaagccgtgggacgtcctgcccaccgtgacgcagatggcgatgaccgacaccacccccttcgggcagcagcgcgtgttcaaggagaaggtcgacacgcggacccaggagcccaaggagggcaccaagaagctcatgaagatcaccgccgagtggctgtggaaggagctgggcaagaagaagacgccgcgcatgtgcacccgggaggagttcacccgcaaggtgcggagcaacgccgccctcggggccatcttcaccgacgagaacaagtggaagtccgcgcgcgaggccgtggaggacagccggttctgggagctggtcgacaaggagcgcaacctgcacctcgagggcaagtgcgagacgtgcgtgtacaacatgatggggaagcgggagaagaagctgggcgagttcgggaaggccaagggctcccgcgccatctggtacatgtggctgggcgcccggttcctcgagttcgaggcgctggggttcctgaacgaggaccactggttcagccgcgagaactccctcagcggcgtcgagggggagggcctgcacaagctggggtacatcctccgggacgtgtccaagaaggagggcggcgccatgtacgccgacgacaccgccgggtgggacacccgcatcaccctggaggacctgaagaacgaggagatggtgacgaaccacatggagggcgagcacaagaagctcgcggaggccatcttcaagctgacctaccagaacaaggtcgtgcgggtgcagcgccccacgccccgggggaccgtcatggacatcatcagccgccgggaccagcgcggcagcggccaggtggggacgtacggcctgaacaccttcaccaacatggaggcccagctcatccggcagatggagggggagggcgtgttcaagaacatccagcacctgaccgtcacggaggaggtggccgtgcagaactggctggcccgcgtcgggcgcgagcggctctcccgcatggcgatcagcggcgacgactgcgtggtgaagcccctggacgaccggttcgccaacgccctgaccgccctcaacgacatgggcaagatccgcaaggacatccagcagtgggagccgtccaaggggtggaacgactggacccaggtccccttctgcagccaccacttccacgagctgatcatgaaggacggccgggtgctggtggtcccctgccgcaaccaggacgagctcatcgggcgggcccgcatctcccagggcgcggggtggagcctgcgggagaccgcctgcctgggcaagtcctacgcccagatgtggagcctcatgtacttccaccgccgggacctgcgcctggccgccaacgcgatctgctccgccgtgcccagccactgggtgccgacgtcccggaccacctggagcatccacgccaagcacgagtggatgaccaccgaggacatgctcacggtctggaaccgcgtgtggatccgggagaacccctggatggaggacaagacccccgtggagtcctgggaggagatcccctacctgggcaagcgcgaggaccagtggtgcgggagcctgatcggcctcacctcccgggccacctgggccaagaacatccaggcggccatcaaccaggtccgcagcctgatcgggaacgaggagtacacggactacatgccgtccatgaagcggttccgccgcgaggaggaggaggccggcgtgctgtggtga

SEQ ID NO: 9527 - RNA, 9876 nt, synthetic construct
  misc_feature 1..9876: note = derived and/or modified CDS sequence (opt1) from DENV-2__FJ432726__SS-prME
  source 1..9876: mol_type = other RNA
agcgcggggatgatcatcatgctgatccccaccgtgatggccttccacctcaccacccgcaacggggagccccacatgatcgtggggatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgcgagccagcacaactaccggccggggtaccacacccagatcgccggcccctggcacctggggaagctggagatggacttcgacttctgcgacggcaccaccgtgatcgtgacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtcaactccctcgtgaccgccggccacggccaggtggacaacttcagcctgggcgtcctgggcatggccctcttcctggaggagatgctgcgcacccgggtggggacgaagcacgccatcctcctggtggccgtctccttcgtgaccctgatcaccggcaacatgagcttcaaggacctcgggcgcgtggtcgtgatggtgggcgccaccatggccgacgacatcgggatgggcgtcacgtacctggcgctgctcgccgccttcaaggtgcggcccaccttcgccgccggcctgctgctccgcaagctgacctccaaggagctgatgatgaccacgatcgggatcgtgctcctgagccagtccaccatccccgagaccgtcctggagctcaccgacgcgctggccctgggcatgatggtgctcaagatcgtgcgcaacatggagaagtaccagctggccgtcacgatcatggccatcctgtgcgtgccgaacgccgtcatcctccagaacgcgtggaaggtgagctgcaccatcctggccgtggtctccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggcgatcatggccgtgggcatggtctccatcctggccagctccctcctgaagaacgacatccccatgaccggccccctggtggccgggggcctcctgaccgtgtgctacgtcctgaccgggcggagcgccgacctcgagctggagcgcgcgacggacgtgaagtgggaggaccaggccgagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtcaagaagcagcgcgcgggggtgctctgggacgtgcccagcccgccgcccatgggcaaggccgagctggaggacggggcctaccggatcaagcagaagggcatcctggggtacagccagatcggcgccggcgtctacaaggaggggaccttccacaccatgtggcacgtgacccgcggcgccgtgctcatgcacaaggggaagcggatcgagccctcctgggcggacgtcaagaaggacctgatcagctacggcgggggctggaagctggagggcgagtggaaggagggggaggaggtccaggtgctcgccctggagcccggcaagaacccccgcgccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccggtccggcgcctacgtcagcgcgatcgcccagaccgagaagtccatcgaggacaaccccgagatcgaggacgacatcttccgcaagcggcgcctgaccatcatggacctgcaccccggggccggcaagacgaagcggtacctccccgccatcgtgcgcgaggcgatcaagcgggggctgcgcaccctgatcctcgccccgacccgggtggtcgccgccgagatggaggaggccctgcgcggcctgcccatccggtaccagacccccgcgatccgcgccgagcacacggggcgcgagatcgtggacctcatgtgccacgccaccttcaccatgcggctgctgagccccgtgcgcgtcccgaactacaacctcatcatcatggacgaggcccacttcaccgaccccgcctccatcgcggcccggggctacatcagcacgcgcgtggagatgggcgaggccgccgggatcttcatgaccgccacgccgcccggcagccgggacccgttcccccagtccaacgcgcccatcatcgacgaggagcgcgagatccccgagcggagctggaactccgggcacgagtgggtgaccgacttcaagggcaagacggtctggttcgtgccgagcatcaaggccgggaacgacatcgccgcctgcctgcgcaagaacggcaagaaggtgatccagctgtcccggaagaccttcgacagcgagtacgtcaagacccgcaccaacgactgggacttcgtggtgacgaccgacatctccgagatgggcgcgaacttcaaggccgagcgggtcatcgacccccgccggtgcatgaagcccgtgatcctcaccgacggggaggagcgcgtgatcctggccggccccatgccggtcacccacagctccgccgcccagcggcgcgggcggatcggccgcaaccccaagaacgagaacgaccagtacatctacatgggggagcccctggagaacgacgaggactgcgcgcactggaaggaggccaagatgctcctggacaacatcaacacgcccgagggcatcatcccgagcatgttcgagcccgagcgggagaaggtggacgccatcgacggcgagtaccgcctgcgcggggaggcccggaagaccttcgtggacctcatgcgccggggcgacctgcccgtctggctggcctacaaggtggcggccgaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgcggccggccggaagtccctgaccctcaacctgatcacggagatgggccgcctgcccaccttcatgacccagaagacccgggacgccctcgacaacctggccgtgctgcacacggcggaggccgggggccgcgcctacaaccacgccctctccgagctgcccgagaccctggagaccctcctgctgctcaccctgctggccacggtcaccgggggcatcttcctcttcctgatgagcggccgggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacgtacgtggtcatcgccatcctgaccgtggtggcggccaccatggccaacgagatgggcttcctggagaagaccaagaaggacctcgggctgggctccatcgccacgcagcagccggagagcaacatcctggacatcgacctccggcccgcctccgcgtggaccctgtacgccgtcgccaccaccttcgtgacgcccatgctgcgccacagcatcgagaacagctccgtgaacgtcagcctcaccgccatcgccaaccaggcgaccgtgctgatgggcctggggaagggctggcccctctccaagatggacatcggggtgccgctgctggccatcggctgctacagccaggtcaaccccatcaccctcacggccgccctgctgctcctggtggcgcactacgccatcatcgggcccggcctgcaggccaaggccacccgggaggcccagaagcgcgcggccgccggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcggaccacctgggccctctgcgaggccctgaccctggcgacggggcccatctccaccctctgggagggcaacccggggcgcttctggaacaccaccatcgccgtgagcatggccaacatcttccggggctcctacctggccggcgccgggctcctcttcagcatcatgaagaacacgaccaacacccgccgcggcaccgggaacatcggcgagacgctgggcgagaagtggaagtcccggctgaacgcgctcggcaagagcgagttccagatctacaagaagtccggcatccaggaggtggaccgcaccctggccaaggaggggatcaagcggggcgagaccgaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgacgaagggcgggcccggccacgaggagcccatcccgatgtccacctacgggtggaacctcgtgcggctgcagagcggcgtggacgtcttcttcatcccgcccgagaagtgcgacaccctgctctgcgacatcggggagtccagccccaacccgaccgtggaggcgggccgcacgctgcgggtgctgaacctcgtcgagaactggctgaacaacaacacccagttctgcatcaaggtgctgaacccctacatgccctccgtgatcgagaagatggaggccctgcagcgcaagtacggcggggccctcgtccggaacccgctgagccgcaacagcacccacgagatgtactgggtgtccaacgccagcggcaacatcgtgtccagcgtcaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcgtaccacggctcctacgagaccaagcagacggggagcgcctccagcatggtgaacggcgtcgtgcgcctgctcaccaagccgtgggacgtgctgcccaccgtcacccagatggccatgacggacaccacccccttcgggcagcagcgcgtgttcaaggagaaggtggacacccggacgcaggagcccaaggagggcaccaagaagctgatgaagatcaccgccgagtggctctggaaggagctgggcaagaagaagaccccgcgcatgtgcacgcgggaggagttcacccgcaaggtccggtccaacgccgcgctgggggccatcttcaccgacgagaacaagtggaagtccgcccgcgaggccgtggaggactcccggttctgggagctcgtggacaaggagcgcaacctgcacctggagggcaagtgcgagacctgcgtctacaacatgatggggaagcgggagaagaagctcggcgagttcgggaaggccaagggcagccgcgcgatctggtacatgtggctgggcgcccggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgccatgtacgcggacgacacggccgggtgggacacccgcatcaccctcgaggacctgaagaacgaggagatggtgaccaaccacatggagggcgagcacaagaagctggccgaggccatcttcaagctcacgtaccagaacaaggtggtccgggtgcagcgccccacgccccgggggaccgtgatggacatcatcagccgccgggaccagcgcggctccgggcaggtcggcacctacggcctgaacacgttcaccaacatggaggcccagctgatccggcagatggagggggagggcgtgttcaagaacatccagcacctcaccgtgaccgaggaggtcgcggtgcacaactggctggcccgcgtggggcgcgagcggctgagccgcatggccatctccggcgacgactgcgtcgtgaagcccctcgacgaccggttcgccaacgccctgacggcgctgaacgacatgggcaagatccgcaaggacatccagcagtgggagccgagcaaggggtggaacgactggacccaggtgcccttctgctcccaccacttccacgagctcatcatgaaggacggccggatcctggtcgtgccctgccgcaaccaggacgagctgatcgggcgggcccgcatcagccagggcgccgggtggtccctccgggagaccgcctgcctgggcaagagctacgcccagatgtggtccctgatgtacttccaccgccgggacctccgcctggcggccaacgccatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcggcaagcgcgaggaccagtggtgcgggtccctgatcggcctgaccagccgggcgacctgggccaagaacatccaggccgccatcaaccaggtgcgctccctcatcgggaacgaggagtacaccgactacatgccgagcatgaagcggttccgccgcgaggaggaggaggcgggcgtgctgtggtga

SEQ ID NO: 9528 - RNA, 9876 nt, synthetic construct
  misc_feature 1..9876: note = derived and/or modified CDS sequence (opt1) from DENV-2__JF730049__SS-prME
  source 1..9876: mol_type = other RNA
agcgcggggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgtggtgggcaacgacacggggaagcacggccaggagatcaaggtcaccccgcagagctccatcaccgaggcggagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggccatgcacacggcgctgaccggcgccaccgagatccagatgagctccgggaacctcctcttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgccaagcgcatggcgatcctgggcgacaccgcctgggacttcgggtccctgggcggggtcttcacgagcatcggcaaggccctccaccaggtgttcggggccatctacggcgccgcgttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgccatccagaaggcgcaggaggaggggatctgcggcatccgctccgtgacgcggctggagaacctcatgtggaagcagatcacccccgagctgaaccacatcctgaccgagaacgaggtgaagctcaccatcatgacgggggacatcaagggcatcatgcaggccgggaagcgcagcctgcggccgcagcccaccgagctgaagtactcctggaagacctggggcaaggccaagatgttcagcaccgagtcctacaaccagacgttcctcatcgacggccccgagaccgccgagtgcccgaacaccaaccgcgcctggaacagcctggaggtcgaggactacgggttcggcgtgttcaccacgaacatctggctgaagctcaaggagaagcaggacgcgttctgcgactccaagctgatgagcgccgccatcaaggacaaccgggccgtgcacgccgacatggggtactggatcgagtccgcgctgaacgacacctggaagatcgagaaggccagcttcatcgaggtcaagaactgccactggcccaagtcccacaccctctggagcaacggcgtgctggagtccgagatgatcatccccaagaacctggccggccccgtgagccagcacaactaccgcccggggtaccacacccagatcgccggcccctggcacctcgggaagctggagatggacttcgacttctgcgacggcaccacggtcatcgtgaccgaggactgcgggaaccggggcccctccctgcgcaccaccacggccagcggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgcgggccacggccaggtggacaacttcagcctcggcgtgctgggcatggccctgttcctcgaggagatgctgaagacgcgggtcgggaccaagcacgccatcctgctcgtggccgtgtccttcgtcaccctgatcaccggcaacatgagcttcaaggacctggggcgcgtggtggtcatggtgggcgcgacgatggccgacgacatcgggatgggcgtgacctacctcgccctgctggccgccttcaaggtccggcccaccttcgcggccggcctcctgctgcgcaagctcacctccaaggagctgatgatgacgaccatcgggatcgtgctgctcagccagtccaccatccccgagaccgtgctggagctgacggacgccctcgccctgggcatgatggtcctgcggatcgtgcgcaacatggagaagtaccagctcgccgtcaccatcatggcgatcctgtgcgtgccgaacgccgtgatcctgcagaacgcctggaaggtcagctgcaccatcctcgccgtggtgtccgtcagccccctgctgctcacctccagccagcagaagacggactggatccccctggccctgaccatcaaggggctcaaccccaccgcgatcttcctgaccacgctgtcccgcaccaacaagaagcggagctggccgctcaacgaggccatcatggccgtgggcatggtgtccatcctggccagctccctgctcaagaacgacatccccatgaccggccccctggtcgccggcgggctgctcaccgtgtgctacgtgctgacggggcgcagcgccgacctggagctcgagcgggccaccgacgtcaagtgggaggaccaggccgagatctccgggagcagccccatcctgtccatcaccatcagcgaggacgggtccatgagcatcaagaacgaggaggaggagcagaccctgacgatcctcatccgcaccggcctgctggtgatctccggcctcttcccgatcagcatccccatcaccgccgcggcctggtacctgtgggaggtgaagaagcagcgggccggggtcctgtgggacgtgcccagcccgccgcccatgggcaaggccgagctcgaggacggggcctaccgcatcaagcagaagggcatcctggggtacagccagatcggcgcgggcgtgtacaaggaggggaccttccacaccatgtggcacgtcacgcggggcgccgtgctgatgcacaaggggaagcgcatcgagccctcctgggccgacgtgaagaaggacctcatcagctacggcgggggctggaagctggagggcgagtggaaggagggggaggaggtccaggtgctggccctcgagcccggcaagaacccccgggccgtgcagaccaagcccgggctgttcaagacctccaccggcacgatcggggcggtcagcctggacttctcccccggcaccagcggctcccccatcatcgacaagaaggggaaggtggtgggcctctacgggaacggcgtcgtgacccgcagcggcgcctacgtgtccgccatcgcccagaccgagaagtccatcgaggacaaccccgagatcgaggacgacatcttccggaagcgccggctgacgatcatggacctgcaccccggggccggcaagaccaagcgctacctgcccgcgatcgtccgggaggccatcaagcgcgggctccggaccctgatcctggccccgacccgcgtggtggccgcggagatggaggaggccctccggggcctgcccatccgctaccagacgcccgccatccgggccgagcacaccgggcgcgagatcgtcgacctgatgtgccacgccaccttcaccatgcgcctcctgtcccccgtgcgggtgccgaactacaacctgatcatcatggacgaggcgcacttcacggaccccgccagcatcgccgcccgcggctacatcagcacccgggtcgagatgggcgaggccgcggggatcttcatgaccgccacgccgcccggctcccgcgacccgttcccccagagcaacgcccccatcatcgacgaggagcgggagatccccgagcgctcctggaacagcgggcacgagtgggtgacggacttcaagggcaagaccgtgtggttcgtcccgtccatcaaggccgggaacgacatcgccgcgtgcctccggaagaacggcaagaaggtgatccagctgagccgcaagaccttcgactccgagtacgtgaagacccggacgaacgactgggacttcgtcgtgaccaccgacatcagcgagatgggcgccaacttcaaggccgagcgcgtgatcgacccccggcgctgcatgaagcccgtcatcctgaccgacggggaggagcgggtgatcctcgccggccccatgccggtgacgcactccagcgcggcccagcgccgggggcgcatcggccggaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgcgagaaggtcgacgccatcgacggcgagtaccggctgcgcggggaggcgcgcaagaccttcgtggacctgatgcggcgcggcgacctccccgtgtggctggcctacaaggtcgccgccgaggggatcaactacgccgaccggcgctggtgcttcgacggcatcaagaacaaccagatcctggaggagaacgtggaggtcgagatctggaccaaggagggggagcggaagaagctcaagccgcgctggctggacgcgcggatctacagcgaccccctggccctcaaggagttcaaggagttcgccgccggccgcaagtccctgacgctgaacctcatcaccgagatgggccggctgcccaccttcatgacccagaagacgcgcgacgccctggacaacctcgcggtgctgcacaccgccgaggccgggggccgggcctacaaccacgcgctgagcgagctccccgagaccctggagaccctgctcctgctgacgctcctggccaccgtgaccgggggcatcttcctgttcctcatgtccggccgcgggatcggcaagatgaccctggggatgtgctgcatcatcaccgccagcatcctgctctggtacgcccagatccagccgcactggatcgccgcgtccatcatcctggagttcttcctgatcgtcctcctgatccccgagcccgagaagcagcggacgccccaggacaaccagctgacctacgtggtgatcgccatcctcaccgtcgtggccgccaccatggccaacgagatgggcttcctggagaagacgaagaaggacctggggctcggcagcatcgcgacccagcagccggagtccaacatcctggacatcgacctgcgccccgccagcgcctggaccctctacgccgtggccaccacgttcgtcacccccatgctgcggcacagcatcgagaactccagcgtgaacgtgtccctgaccgcgatcgccaaccaggccaccgtcctcatgggcctggggaagggctggcccctgagcaagatggacatcggggtgccgctcctggccatcggctgctactcccaggtgaaccccatcacgctgaccgccgcgctcctgctgctcgtcgcccactacgccatcatcgggcccggcctgcaggccaaggcgacccgcgaggcccagaagcgggccgccgccggcatcatgaagaaccccaccgtggacgggatcacggtgatcgacctggacccgatcccctacgaccccaagttcgagaagcagctcggccaggtcatgctgctgatcctctgcgtgacccaggtgctgatgatgcgcaccacctgggcgctgtgcgaggccctcacgctggccaccgggcccatcagcaccctgtgggagggcaacccggggcggttctggaacaccacgatcgccgtctccatggccaacatcttccgcggcagctacctcgcgggcgccgggctgctgttctccatcatgaagaacaccaccaacacccggcgcggcacggggaacatgggcgagaccctcggcgagaagtggaagtcccgcctgaacgccctggggaagtccgagttccagatctacaagaagtccggcatccaggaggtggaccggaccctcgccaaggaggggatcaagcgcggcgagaccgaccaccacgccgtgtcccgggggagcgcgaagctgcgctggttcgtcgagcggaacatggtgacgcccgagggcaaggtggtcgacctgggctgcgggcgcggcgggtggtcctactactgcggcgggctcaagaacgtgcgggaggtgaagggcctgaccaagggcgggcccggccacgaggagcccatcccgatgagcacctacgggtggaacctggtccgcctccagtccggcgtggacgtgttcttcatcccgcccgagaagtgcgacaccctgctgtgcgacatcggggagagctcccccaacccgacggtcgaggccggccggaccctccgcgtgctgaacctggtggagaactggctcaacaacaacacccagttctgcatcaaggtcctgaacccctacatgcccagcgtgatcgagaagatggaggccctgcagcggaagtacggcggggccctggtgcgcaacccgctcagccggaactccacccacgagatgtactgggtcagcaacgcgtccggcaacatcgtgagctccgtgaacatgatcagccgcatgctgatcaaccggttcaccatgcgccacaagaaggccacgtacgagcccgacgtcgacctggggtccggcacccggaacatcgggatcgagagcgagatccccaacctcgacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtggtccggctgctgaccaagccgtgggacgtgctccccaccgtgacgcagatggccatgaccgacaccacccccttcgggcagcagcgcgtcttcaaggagaaggtggacacgcgcacccaggagcccaaggagggcaccaagaagctgatgaagatcaccgcggagtggctgtggaaggagctcggcaagaagaagacgccgcggatgtgcacccgcgaggagttcacccggaaggtgcgcagcaacgccgccctgggggccatcttcaccgacgagaacaagtggaagtccgcccgggaggcggtcgaggacagccgcttctgggagctggtggacaaggagcggaacctccacctggagggcaagtgcgagacgtgcgtctacaacatgatggggaagcgcgagaagaagctgggcgagttcgggaaggccaagggctcccgggccatctggtacatgtggctcggcgcccgcttcctggagttcgaggccctggggttcctcaacgaggaccactggttcagccgggagaactccctgagcggcgtggagggggagggcctgcacaagctcgggtacatcctgcgcgacgtgagcaagaaggagggcggcgcgatgtacgccgacgacaccgccgggtgggacacccggatcaccctggaggacctcaagaacgaggagatggtcacgaaccacatggagggcgagcacaagaagctggccgaggcgatcttcaagctgacctaccagaacaaggtggtgcgcgtccagcggcccacgccccgggggaccgtgatggacatcatctcccggcgcgaccagcggggcagcggccaggtggggacgtacggcctcaacaccttcaccaacatggaggcccagctgatccgccagatggagggggagggcgtcttcaagaacatccagcacctgaccgtgacggaggaggtggccgtccagaactggctcgcccgggtggggcgcgagcgcctgtcccggatggccatcagcggcgacgactgcgtggtcaagcccctggacgaccgcttcgcgaacgccctcaccgccctgaacgacatgggcaagatccggaaggacatccagcagtgggagccgtccaaggggtggaacgactggacccaggtgcccttctgcagccaccacttccacgagctgatcatgaaggacggccgcgtgctcgtcgtgccctgccggaaccaggacgagctgatcgggcgcgcccggatctcccagggcgccgggtggagcctgcgcgagaccgcgtgcctcggcaagtcctacgcccagatgtggagcctgatgtacttccaccggcgcgacctgcggctcgccgccaacgccatctgctccgcggtgcccagccactgggtcccgacgtcccgcaccacctggagcatccacgccaagcacgagtggatgaccaccgaggacatgctgacggtgtggaaccgggtgtggatccgcgagaacccctggatggaggacaagacccccgtcgagtcctgggaggagatcccctacctgggcaagcgggaggaccagtggtgcgggagcctcatcggcctgacctcccgcgccacctgggccaagaacatccaggccgcgatcaaccaggtgcggagcctgatcgggatcgaggagtacacggactacatgccgagcatgaagcgcttccggcgcgaggaggaggaggccggcgtgctctggtga

SEQ ID NO: 9529 - RNA, 9876 nt, synthetic construct
  misc_feature 1..9876: note = derived and/or modified CDS sequence (opt1) from DENV-2__FJ562098__SS-prME
  source 1..9876: mol_type = other RNA
agcgcggggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgccacggagaaggactcccccgtgaacatcgaggcggagccgcccttcggggacagctacatcatcatcggcgtcgagccggggcagctgaagctcaactggttcaagaagggctccagcatcgggcagatgttcgagaccaccatgcgcggcgccaagcgcatggccatcctgggcgacaccgcctgggacttcgggtccctgggcggggtgttcacgagcatcggcaaggccctccaccaggtgttcggggcgatctacggcgccgccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggcgagcgccatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccatcgagctgaagtactcctggaagacgtggggcaaggcgaagatgctcagcaccgagtcccacaaccagaccttcctgatcgacggccccgagaccgccgagtgcccgaacacgaaccgcgcctggaacagcctggaggtggaggactacgggttcggcgtgttcaccaccaacatctggctccggctgaaggagaagcaggacgccttctgcgactccaagctgatgagcgccgcgatcaaggacaaccgcgccgtccacgccgacatggggtactggatcgagtccgccctcaacgacacctggaagatcgagaaggccagcttcatcgaggtgaagaactgccactggcccaagtcccacacgctgtggagcaacggcgtgctggagtccgagatggtcatccccaagaacctcgcgggccccgtgagccagcacaactaccggccggggtaccacacccagatcgccggcccctggcacctggggaagctggagatggacttcgacttctgcgacggcaccaccgtgatcgtcaccgaggactgcgggaaccgcggcccctccctccggacgaccaccgccagcggcaagctgatcaccgagtggtgctgccgcagctgcacgctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggaccaagcacgccatcctcctggtcgccgtgtccttcgtgacgctgatcaccggcaacatgagcttcaaggacctcgggcgcgtcgtggtgatggtcggcgccaccatggccgacgacatcgggatgggcgtgacctacctggcgctgctcgccgccttcaaggtgcggcccacgttcgccgccggcctgctgctccgcaagctgacctccaaggagctgatgatgaccaccatcgggatcgtcctcctgagccagtccacgatccccgagaccgtgctggagctcaccgacgcgctggccctgggcatgatggtgctcaagatcgtccgcaacatggagaagtaccagctggccgtgaccatcatggccatcctgtgcgtcccgaacgccgtgatcctccagaacgcgtggaaggtgagctgcacgatcctggccgtcgtgtccgtgagccccctgctcctgacctccagccagcagaagaccgactggatccccctggccctcaccatcaaggggctgaaccccacggccatcttcctgaccaccctctcccggaccaacaagaagcgcagctggccgctgaacgaggcgatcatggccgtcggcatggtgtccatcctggccagctccctcctgaagaacgacatccccatgacgggccccctggtggccgggggcctcctgaccgtctgctacgtgctgaccgggcggagcgccgacctcgagctggagcgcgcgaccgacgtgaagtgggaggaccaggccgagatctccggcagcagccccatcctgtccatcacgatcagcgaggacgggtccatgagcatcaagaacgaggaggaggagcagaccctcaccatcctgatccggaccggcctgctcgtcatctccggcctgttcccgatcagcatccccatcacggccgccgcctggtacctgtgggaggtgaagaagcagcgcgcgggggtgctctgggacgtccccagcccgccgcccatgggcaaggccgagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggcggacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagacgaacaccggcaccatcggggccgtgtccctcgacttcagccccggcacctccggcagccccatcatcgacaagaaggggaaggtcgtgggcctgtacgggaacggcgtggtcacgcggtccggcgcctacgtgagcgcgatcgcccagaccgagaagtccatcgaggacaaccccgagatcgaggacgacatcttccgcaagcggcgcctgaccatcatggacctgcaccccggggccggcaagaccaagcggtacctccccgccatcgtgcgcgaggcgatcaagcgggggctgcgcacgctgatcctcgccccgacccgggtcgtggccgccgagatggaggaggccctgcgcggcctgcccatccggtaccagacccccgcgatccgcgccgagcacaccgggcgcgagatcgtggacctcatgtgccacgccacgttcaccatgcggctgctgagccccgtccgcgtgccgaactacaacctcatcatcatggacgaggcccacttcaccgaccccgcctccatcgcggcccggggctacatcagcacccgcgtggagatgggcgaggccgccgggatcttcatgacggccacgccgcccggcagccgggacccgttcccccagtccaacgcgcccatcatcgacgaggagcgcgagatccccgagcggagctggaactccgggcacgagtgggtcaccgacttcaagggcaagaccgtgtggttcgtgccgagcatcaaggccgggaacgacatcgccgcctgcctgcgcaagaacggcaagaaggtcatccagctgtcccggaagacgttcgacagcgagtacgtgaagacccgcaccaacgactgggacttcgtggtcaccacggacatctccgagatgggcgcgaacttcaaggccgagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgggagaaggtggacgccatcgacggcgagtaccgcctgcgcggggaggcccggaagacgttcgtcgacctcatgcgccggggcgacctgcccgtgtggctggcctacaaggtggcggccgaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgcggccggccggaagtccctgaccctcaacctgatcaccgagatgggccgcctgcccacgttcatgacccagaagacccgggacgccctcgacaacctggccgtcctgcacaccgcggaggccgggggccgcgcctacaaccacgccctctccgagctgcccgagacgctggagaccctcctgctgctcaccctgctggccaccgtgaccggcgggatcttcctcttcctgatgagcgggcgggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacctacgtcgtgatcgccatcctgacggtggtcgcggccaccatggccaacgagatgggcttcctggagaagaccaagaaggacctcgggctgggctccatcgccacccagcagccggagagcaacatcctggacatcgacctccggcccgcctccgcgtggacgctgtacgccgtggccaccaccttcgtgacccccatgctgcgccacagcatcgagaacagctccgtcaacgtgagcctcacggccatcgccaaccaggcgaccgtgctgatgggcctggggaagggctggcccctctccaagatggacatcggggtcccgctgctggccatcggctgctacagccaggtgaaccccatcaccctcaccgccgccctgctgctcctggtggcgcactacgccatcatcgggcccggcctgcaggccaaggccacgcgggaggcccagaagcgcgcggccgccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggacgacctgggccctctgcgaggccctgaccctggcgaccgggcccatctccacgctctgggagggcaacccggggcgcttctggaacaccaccatcgccgtgagcatggccaacatcttccggggctcctacctggccggcgccgggctcctcttcagcatcatgaagaacaccacgaacacccgccgcggcaccgggaacatgggcgagaccctgggcgagaagtggaagtcccggctgaacgcgctcggcaagagcgagttccagatctacaagaagtccggcatccaggaggtcgaccgcacgctggccaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggcccggccacgaggagcccatcccgatgtccacgtacgggtggaacctcgtgcggctgcagagcggcgtcgacgtgttcttcatcccgcccgagaagtgcgacaccctgctctgcgacatcggggagtccagccccaacccgaccgtggaggcgggccgcaccctgcgggtcctgaacctcgtggagaactggctgaacaacaacacgcagttctgcatcaaggtgctgaacccctacatgccctccgtcatcgagaagatggaggccctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacccgcaacatcgggatcgagtccgagatccccaacctggacatcatcggcaagcggatcgagaagatcaagcaggagcacgagacgagctggcactacgaccaggaccacccctacaagacctgggcgtaccacggctcctacgagaccaagcagaccgggagcgcctccagcatggtcaacggcgtggtgcgcctgctcacgaagccgtgggacgtcctgcccaccgtgacccagatggccatgaccgacacgacccccttcgggcagcagcgcgtgttcaaggagaaggtcgacacccggacccaggagcccaaggagggcacgaagaagctgatgaagatcaccgccgagtggctctggaaggagctgggcaagaagaagaccccgcgcatgtgcacccgggaggagttcacgcgcaaggtgcggtccaacgccgcgctgggggccatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgcgatctggtacatgtggctgggcgcccggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgcggacgacaccgccgggtgggacacgcgcatcaccctcgaggacctgaagaacgaggagatggtgaccaaccacatggagggcgagcacaagaagctggccgaggccatcttcaagctcacctaccagaacaaggtcgtgcgggtgcagcgccccacgccccgggggaccgtcatggacatcatcagccgccgggaccagcgcggctccggccaggtgggcacctacggcctgaacaccttcacgaacatggaggcccagctgatccggcagatggagggggagggcgtgttcaagaacatccagcacctcaccgtcaccgaggaggtggcggtgcagaactggctggcccgcgtcgggcgcgagcggctgagccgcatggccatctccggcgacgactgcgtggtgaagcccctcgacgaccggttcgccaacgccctgaccgcgctgaacgacatgggcaagatccgcaaggacatccagcagtgggagccgagcaaggggtggaacgactggacgcaggtccccttctgctcccaccacttccacgagctcatcatgaaggacggccgggtgctggtggtcccctgccgcaaccaggacgagctgatcgggcgggcccgcatcagccagggcgccgggtggtccctccgggagaccgcctgcctgggcaagagctacgcccagatgtggtccctgatgtacttccaccgccgggacctccgcctggcggccaacgccatctgcagcgccgtgccctcccactgggtgccgaccagccggaccacgtggtccatccacgccaagcacgagtggatgaccaccgaggacatgctgaccgtctggaaccgcgtgtggatccgggagaacccctggatggaggacaagacccccgtggagagctgggaggagatcccctacctcggcaagcgcgaggaccagtggtgcgggtccctgatcggcctgacgagccgggcgacctgggccaagaacatccaggccgccatcaaccaggtccgctccctcatcgggaacgaggagtacaccgactacatgccgagcatgaagcggttccgccgcgaggaggaggaggcgggcgtgctgtggtga

SEQ ID NO: 9530 - RNA, 9876 nt, synthetic construct
  misc_feature 1..9876: note = derived and/or modified CDS sequence (opt1) from DENV-2__FJ859028__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaagaacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtggtcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggcggggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtcacgcccatgctgcggcacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgcgaggcccagaagcgggccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatctccaccctctgggagggcaacccggggcggttctggaacaccaccatcgcggtcagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtggtccggctgctcaccaagccgtgggacgtgctgcccaccgtgacccagatggccatgacggacaccacccccttcgggcagcagcgcgtcttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtcgaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtgagcaagaaggagggcggcgccatgtacgccgacgacacggcggggtgggacacccggatcaccctcgaggacctgaagaacgaggagatggtcaccaaccacatggagggcgagcacaagaagctggccgaggccatcttcaagctcacgtaccagaacaaggtggtgcgcgtccagcggcccacgccccgggggaccgtgatggacatcatcagccggcgcgaccagcggggctccggccaggtggggacctacggcctgaacacgttcaccaacatggaggcccagctgatccgccagatggagggggagggcgtcttcaagaacatccagcacctcaccgtgaccgaggaggtggccgtccagaactggctggcgcgggtggggcgcgagcgcctgagccggatggccatctccggcgacgactgcgtggtcaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtcccgaccagccgcacgacctggtccatccacgccaagcacgagtggatgaccaccgaggacatgctgaccgtgtggaaccgggtgtggatccgcgagaacccctggatggaggacaagacgcccgtcgagagctgggaggagatcccctacctcggcaagcgggaggaccagtggtgcgggtccctgatcggcctgaccagccgcgccacctgggcgaagaacatccaggtggccatcaaccaggtgcggtccctcatcgggaacgaggagtacaccgactacatgccgagcatgaagcgcttccggcgcgaggaggaggaggccggcgtcctgtggtga

SEQ ID NO: 9531 - RNA, 9876 nt, synthetic construct
  misc_feature 1..9876: note = derived and/or modified CDS sequence (opt1) from DENV-2__FJ410200__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcaacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatgacggacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgagaacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacatggaggtcgagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtgctgcacaccgccgaggccgggggccgggcgtacaaccacgccctctccgagctgcccgagaccctggagaccctcctgctgctcacgctgctggccaccgtcaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtggtcatcgccatcctgaccgtggtggccgccaccatggcgaacgagatgggcttcctggagaagacgaagaaggacctcgggctgggctccatcgccacccgccagccggagagcaacatcctggacatcgacctccggcccgcctccgcctggaccctgtacgccgtcgcgaccacgttcgtgacccccatgctgcgccacagcatcgagaacagctccgtgaacgtcagcctcaccgccatcgccaaccaggccaccgtgctgatgggcctggggaagggctggcccctctccaagatggacatcggggtgccgctgctggccatcggctgctacagccaggtcaaccccatcacgctcaccgcggccctgctgctcctggtggcccactacgccatcatcgggcccggcctgcaggcgaaggccacccgggaggcccagaagcgcgccgccgcgggcatcatgaagaaccccaccgtggacgggatcacggtcatcgacctcgacccgatcccctacgaccccaagttcgagaagcagctgggccaggtgatgctgctcgtgctgtgcgtcacccaggtgctgatgatgcggaccacctgggccctctgcgaggccctgacgctggccaccgggcccatctccaccctctgggagggcaacccggggcgcttctggaacaccacgatcgccgtgagcatggcgaacatcttccggggctcctacctggccggcgccgggctcctcttcagcatcatgaagaacaccaccaacacccgccgcggcacggggaacatgggcgagaccctgggcgagaagtggaagtcccggctgaacgccctcgggaagtccgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacgcccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgacggtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctgctcaccaagccgtgggacgtcctgcccaccgtgacgcagatggcgatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgccggtgcacccgcgaggagttcacccggaaggtgcgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtcgtgcgcgtgcagcggcccacgccccgggggaccgtcatggacatcatcagccggcgcgaccagcggggctccggccaggtggggacgtacggcctgaacaccttcaccaacatggaggcccagctgatccgccagatggagggggagggcgtgttcaagaacatccagcacctcaccgtcacggaggaggtggccgtgaagaactggctggcccgcgtcgggcgggagcgcctgagccggatggcgatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggccaagaacatccaggcggccatcaaccaggtccggtccctcatcgggaacgaggagtacacggactacatgccgagcatgaagcgcttccgccgggaggaggaggaggccggcgtgctgtggtga

SEQ ID NO: 9532 - RNA, 9876 nt, synthetic construct
  misc_feature 1..9876: note = derived and/or modified CDS sequence (opt1) from DENV-2__FJ410202__SS-prME
  source 1..9876: mol_type = other RNA
agcgccgggatgatcatcatgctgatccccaccgtgatggccttccacctcaccacccggaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcgtcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggcggggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgaggtgtggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggtcgggggccgggcgtacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacgtacgtcgtgatcgccatcctgaccgtggtcgccgccaccatggcgaacgagatgggcttcctggagaagaccaagaaggacctcgggctgggctccatcgccacgcagcagccggagagcaacatcctggacatcgacctccgccccgcctccgcctggaccctgtacgccgtggcgaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcaccctcacggcggccctgctgctcctggtggcccactacgccatcatcgggcccggcctgcaggcgaaggccacccgcgaggcccagaagcgggccgccgcgggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgccgtgagcatggcgaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagcggtccggcatccaggaggtcgaccgcaccctggccaaggaggggatcaagcggggcgagaccgaccaccacgcggtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctcaccaagccgtgggacgtcctgcccaccgtgacccagatggcgatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggccatcttcaccgacgagaacaagtggaagtccgcgcgcgaggccgtcgaggactcccggttctgggagctcgtggacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacacggccgggtgggacacccgcatcaccctcgaggacctgaagaacgaggagatggtgaccaaccacatggagggcgagcacaagaagctggcggaggccatcttcaagctcacgtaccagaacaaggtcgtgcgggtgcagcgccccacgccccgggggaccgtcatggacatcatcagccgccgggaccagcgcggctccggccaggtggggacctacggcctgaacacgttcaccaacatggaggcccagctgatccggcagatggagggggagggcgtgttcaagaacatccagcacctcaccgtcaccgaggaggtggccgtgcagaactggctggcccgcgtcgggcgcgagcggctgagccgcatggcgatctccggcgacgactgcgtggtgaagcccctcgacgaccggttcgccaacgccctgacggccctgaacgacatgggcaagatccgcaaggacatccagcagtgggagccgagcaaggggtggaacgactggacccaggtccccttctgctcccaccacttccacgagctcatcatgaaggacggccgggtgctggtggtcccctgccgcaaccaggacgagctgatcgggcgggcccgcatcagccagggcgcggggtggtccctccgggagaccgcctgcctgggcaagagctacgcccagatgtggtccctgatgtacttccaccgccgggacctccgcctggccgccaacgcgatctgcagcgccgtgccctcccactgggtgccgaccagccggacgacctggtccatccacgccaagcacgagtggatgaccaccgaggacatgctgaccgtctggaaccgcgtgtggatccgggagaacccctggatggaggacaagacgcccgtggagagctgggaggagatcccctacctcggcaagcgcgaggaccagtggtgcgggtccctgatcggcctgaccagccgggccacctgggccaagaacatccaggcggccatcaaccaggtccgctccctcatcgggaacgaggagtacatcgactacatgccgagcatgaagcggttccgccgcgaggaggaggaggccggcgtgctgtggtga

SEQ ID NO: 9533 - RNA, 9876 nt, synthetic construct
  misc_feature 1..9876: note = derived and/or modified CDS sequence (opt1) from DENV-2__FJ410208__SS-prME
  source 1..9876: mol_type = other RNA
agcgccgggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcggatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcaacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatgacggacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacatggaggtcgagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtgctgcacaccgccgaggccgggggccgggcgtacaaccacgccctctccgagctgcccgagaccctggagaccctcctgctgctcacgctgctggccaccgtcaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtggtcatcgccatcctgaccgtggtggccgccaccatggcgaacgagatgggcttcctggagaagacgaagaaggacctcgggctgggctccatcgccacccgccagccggagagcaacatcctggacatcgacctccggcccgcctccgcctggaccctgtacgccgtcgcgaccacgttcgtgacccccatgctgcgccacagcatcgagaacagctccgtgaacgtcagcctcaccgccatcgccaaccaggccaccgtgctgatgggcctggggaagggctggcccctctccaagatggacatcggggtgccgctgctggccatcggctgctacagccaggtcaaccccatcacgctcaccgcggccctgctgctcctggtggcccactacgccatcatcgggcccggcctgcaggcgaaggccacccgggaggcccagaagcgcgccgccgcgggcatcatgaagaaccccaccgtggacgggatcacggtcatcgacctcgacccgatcccctacgaccccaagttcgagaagcagctgggccaggtgatgctgctcgtgctgtgcgtcacccaggtgctgatgatgcggaccacctgggccctctgcgaggccctgacgctggccaccgggcccatctccaccctctgggagggcaacccggggcgcttctggaacaccacgatcgccgtgagcatggcgaacatcttccggggctcctacctggccggcgccgggctcctcttcagcatcatgaagaacaccaccaacacccgccgcggcacggggaacatgatcgagaccctgggcgagaagtggaagtcccggctgaacgccctcggcaagagcgagttccagatctacaagaagtccgggatccaggaggtcgaccgcaccctggccaaggagggcatcaagcgcggggagaccgaccaccacgcggtgagccgcggctccgccaagctgcggtggttcgtggagcgcaacatggtcacgcccgaggggaaggtggtggacctcggctgcggccgcggcgggtggagctactactgcgggggcctgaagaacgtccgcgaggtgaaggggctgaccaagggcggccccgggcacgaggagcccatcccgatgtccacctacggctggaacctcgtgcggctgcagagcggggtcgacgtgttcttcatcccgcccgagaagtgcgacaccctgctctgcgacatcggcgagtccagccccaacccgacggtggaggccgggcgcaccctgcgggtcctgaacctcgtggagaactggctgaacaacaacacccagttctgcatcaaggtgctgaacccctacatgccctccgtcatcgagaagatggaggccctgcagcgcaagtacggcggcgcgctcgtgcggaacccgctgagccgcaacagcacccacgagatgtactgggtgtccaacgccagcgggaacatcgtctccagcgtgaacatgatctcccggatgctgatcaaccgcttcaccatgcggcacaagaaggccacgtacgagcccgacgtggacctcggcagcgggacccgcaacatcggcatcgagtccgagatccccaacctggacatcatcgggaagcggatcgagaagatcaagcaggagcacgagaccagctggcactacgaccaggaccacccctacaagacctgggcctaccacggctcctacgagacgaagcagaccggcagcgcctccagcatggtcaacggggtggtgcgcctgctcaccaagccgtgggacgtcctgcccaccgtgacgcagatggcgatgaccgacaccacccccttcggccagcagcgcgtgttcaaggagaaggtcgacacgcggacccaggagcccaaggaggggaccaagaagctgatgaagatcaccgccgagtggctctggaaggagctgggcaagaagaagacgccgcgcatgtgcacccgggaggagttcacccgcaaggtgcggtccaacgccgccctgggcgccatcttcaccgacgagaacaagtggaagtccgcgcgcgaggccgtggaggactcccggttctgggagctcgtcgacaaggagcgcaacctgcacctggaggggaagtgcgagacgtgcgtgtacaacatgatgggcaagcgggagaagaagctcggggagttcggcaaggccaaggggagccgcgccatctggtacatgtggctgggcgcccggttcctggagttcgaggcgctcggcttcctgaacgaggaccactggttctcccgcgagaacagcctgtccggggtcgagggcgaggggctccacaagctgggctacatcctgcgggacgtgagcaagaaggagggcggggccatgtacgccgacgacaccgccggctgggacacccgcatcaccctcgaggacctgaagaacgaggagatggtgacgaaccacatggagggggagcacaagaagctggcggaggccatcttcaagctcacctaccagaacaaggtcgtgcgggtgcagcgccccacgccccggggcaccgtcatggacatcatcagccgccgggaccagcgcgggtccggccaggtggggacgtacggcctgaacaccttcaccaacatggaggcccagctgatccggcagatggagggcgagggggtgttcaagaacatccagcacctcaccgtcacggaggaggtggccgtgaagaactggctggcccgcgtcggccgcgagcggctgagccgcatggcgatctccggggacgactgcgtggtgaagcccctcgacgaccggttcgccaacgccctgaccgccctgaacgacatgggcaagatccgcaaggacatccagcagtgggagccgagcaagggctggaacgactggacccaggtccccttctgctcccaccacttccacgagctcatcatgaaggacgggcgggtgctggtggtcccctgccgcaaccaggacgagctgatcggccgggcccgcatcagccagggggcgggctggtccctccgggagaccgcctgcctgggcaagagctacgcccagatgtggtccctgatgtacttccaccgccgggacctccgcctggccgccaacgcgatctgcagcgccgtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctcggcaagcgcgaggaccagtggtgcggctccctgatcgggctgaccagccgggccacctgggccaagaacatccaggcggccatcaaccaggtccgctccctcatcggcaacgaggagtacacggactacatgccgagcatgaagcggttccgccgcgaggaggaggaggccggggtgctgtggtga

SEQ ID NO: 9534 - RNA, 9876 nt, synthetic construct
  misc_feature 1..9876: note = derived and/or modified CDS sequence (opt1) from DENV-2__FJ461305__SS-prME
  source 1..9876: mol_type = other RNA
agcgcggggatgatcatcatgctgatccccaccgtgatggccttccacctcaccacccggaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcagatcgacaacttcagcctgggcgtcctgggcatggccctcttcctggaggagatgctgaagacccgggtggggacgaagcacgcgatcctcctggtggccgtctccttcgtgaccctgatcaccggcaacatgagcttcaaggacctcgggcgcgtggtcgtgatggtgggcgccaccatggccgacgacatcgggatgggcgtcacgtacctggccctgctcgcggccttcaaggtgcggcccaccttcgccgccggcctgctgctccgcaagctgacctccaaggagctgatgatgaccacgatcgggatcgtgctcctgagccagtccaccatccccgagaccgtcctggagctcaccgacgccctggcgctgggcatgatggtgctcaagatcgtgcggaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccgcacgaacaagaagcgcagctggccgctgaacgaggccatcatggcggtgggcatggtctccatcctggccagctccctcctgaagaacgacatccccatgaccggccccctggtggccgggggcctcctgaccgtgtgctacgtcctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtcaagaagcagcgcgccggggtgctctgggacgtgcccagcccgccgcccatgggcaaggcggagctggaggacggggcctaccggatcaagcagaagggcatcctggggtacagccagatcggcgccggcgtctacaaggaggggaccttccacaccatgtggcacgtgacccgcggcgccgtgctcatgcacaaggggaagcggatcgagccctcctgggccgacgtcaagaaggacctgatcagctacggcgggggctggaagctggagggcgagtggaaggagggggaggaggtccaggtgctcgcgctggagcccggcaagaacccccgcgccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccggtccggcgcctacgtcagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtggtcgccgccgagatggaggaggccctgcgcggcctgcccatccggtaccagacccccgccatccgcgcggagcacacggggcgggagatcgtggacctcatgtgccacgccaccttcaccatgcgcctgctgagccccgtgcgcgtcccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtctggttcgtgccgagcatcaaggcggggaacgacatcgccgcctgcctgcgcaagaacggcaagaaggtgatccagctgtcccggaagaccttcgacagcgagtacgtcaagacccgcaccaacgactgggacttcgtggtgacgaccgacatctccgagatgggcgccaacttcaaggcggagcgggtcatcgacccccgccggtgcatgaagcccgtgatcctcaccgacggggaggagcgcgtgatcctggccggccccatgccggtcacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccgcaagaccttcgtggacctcatgcgccggggcgacctgcccgtctggctggcctacaaggtggccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtgctgcacacggccgaggccggcgggcgcgcctacaaccacgccctctccgagctgcccgagaccctggagaccctcctgctgctcaccctgctggccacggtcaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtggtcatcgccatcctgaccgtggtggccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtcgccaccaccttcgtgacgcccatgctgcgccacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcaccctcacggccgccctgctgctcctggtggcccactacgcgatcatcgggcccggcctgcaggccaaggccacccgggaggcccagaagcgcgccgcggccggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccggggcaccgggaacatgggcgagacgctgggcgagaagtggaagtcccgcctgaacgccctcggcaagagcgagttccagatctacaagaagtccggcatccaggaggtggaccgcaccctggcgaaggaggggatcaagcggggcgagaccgaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgacgaagggcgggcccggccacgaggagcccatcccgatgtccacctacgggtggaacctcgtgcggctgcagagcggcgtggacgtcttcttcatcccgcccgagaagtgcgacaccctgctctgcgacatcggggagtccagccccaacccgaccgtggaggccggccgcacgctgcgggtgctgaacctcgtcgagaactggctgaacaacaacacccagttctgcatcaaggtgctgaacccctacatgccctccgtgatcgagaagatggaggcgctgcagcgcaagtacggcggggccctcgtccggaacccgctgagccgcaacagcacccacgagatgtactgggtgtccaacgccagcggcaacatcgtgtccagcgtcaacatgatctcccggatgctgatcaaccgcttcaccatgcggcacaagcgcgccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggtcgccgtgcagaactggctggcgcgggtggggcgcgagcgcctgagccggatggccatctccggcgacgactgcgtcgtgaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacaccgactacatgccgagcatgaagcgcttccggcgcgaggaggaggaggccggcgtcctgtggtga

SEQ ID NO: 9535 - RNA, 9876 nt, synthetic construct
  misc_feature 1..9876: note = derived and/or modified CDS sequence (opt1) from DENV-2__FJ410215__SS-prME
  source 1..9876: mol_type = other RNA
agcgccggcatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccgccatggccgacgacatcgggatgggcgtgacctacctggcgctgctcgccgccttcaaggtgcgccccacgttcgccgccggcctgctgctccggaagctgacctccaaggagctgatgatgaccaccatcgggatcgtcctcctgagccagtccacgatccccgagaccgtgctggagctcaccgacgcgctggccctgggcatgatggtgctcaagatcgtccgcaacatggagaagtaccagctggccgtgaccatcatggccatcctgtgcgtcccgaacgccgtgatcctccagaacgcgtggaaggtgagctgcacgatcctggccgtcgtgtccgtgagccccctgctcctgacctccagccagcagaagaccgactggatccccctggccctcaccatcaaggggctgaaccccacggccatcttcctgaccaccctctcccgcaccaacaagaagcggagctggccgctgaacgaggcgatcatggccgtcggcatggtgtccatcctggccagctccctcctgaagaacgacatccccatgacgggccccctggtggccgggggcctcctgaccgtctgctacgtgctgaccgggcgcagcgccgacctcgagctggagcgggcgaccgacgtgaagtgggaggaccaggccgagatctccggcagcagccccatcctgtccatcacgatcagcgaggacgggtccatgagcatcaagaacgaggaggaggagcagaccctcaccatcctgatccgcaccggcctgctcgtcatctccggcctgttcccgatcagcatccccatcacggccgccgcctggtacctgtgggaggtgaagaagcagcgggcgggggtgctctgggacgtccccagcccgccgcccatgggcaaggccgagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggcggacgtgaagaaggacctgatcagctacggcgggggctggaagctggagggcgagtggaaggagggggaggaggtgcaggtcctcgccctggagcccggcaagaacccccgggccgtgcagaccaagcccgggctgttcaagacgaacaccggcaccatcggggccgtgtccctcgacttcagccccggcacctccggcagccccatcatcgacaagaaggggaaggtcgtgggcctgtacgggaacggcgtggtcacgcgctccggcgcctacgtgagcgcgatcgcccagaccgagaagtccatcgaggacaaccccgagatcgaggacgacatcttccggaagcgccggctgaccatcatggacctgcaccccggggccggcaagaccaagcgctacctccccgccatcgtgcgggaggcgatcaagcgcgggctgcggacgctgatcctcgccccgacccgcgtcgtggccgccgagatggaggaggccctgcggggcctgcccatccgctaccagacccccgcgatccgggccgagcacaccgggcgcgagatcgtggacctcatgtgccacgccacgttcaccatgcgcctgctgagccccgtccgggtgccgaactacaacctcatcatcatggacgaggcccacttcaccgaccccgcctccatcgcggcccgcggctacatcagcacccgggtggagatgggcgaggccgccgggatcttcatgacggccacgccgcccggcagccgcgacccgttcccccagtccaacgcgcccatcatcgacgaggagcgggagatccccgagcgcagctggaactccgggcacgagtgggtcaccgacttcaagggcaagaccgtgtggttcgtgccgagcatcaaggccgggaacgacatcgccgcctgcctgcggaagaacggcaagaaggtcatccagctgtcccgcaagacgttcgacagcgagtacgtgaagacccggaccaacgactgggacttcgtggtcaccacggacatctccgagatgggcgcgaacttcaaggccgagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgcgagaaggtggacgccatcgacggcgagtaccggctgcgcggggaggcccgcaagacgttcgtcgacctcatgcggcgcggcgacctgcccgtgtggctggcctacaaggtggcggccgaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgcggccggccgcaagagcctgaccctcaacctgatcaccgagatgggccggctgcccacgttcatgacccagaagacccgcgacgccctcgacaacctggccgtcctgcacaccgcggaggccgggggccgggcctacaaccacgccctctccgagctgcccgagacgctggagaccctcctgctgctcaccctgctggccaccgtgaccggcgggatcttcctcttcctgatgagcgggcgcgggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcggacgccccaggacaaccagctcacctacgtcgtgatcgccatcctgacggtggtcgcggccaccatggccaacgagatgggcttcctggagaagaccaagaaggacttcgggctcggctccatcgccacccagcagccggagagcaacatcctggacatcgacctgcgccccgcctccgcgtggacgctctacgccgtggccaccaccttcgtgacccccatgctgcggcacagcatcgagaacagctccgtcaacgtgagcctgacggccatcgccaaccaggcgaccgtgctcatgggcctggggaagggctggcccctgtccaagatggacatcggggtcccgctcctggccatcggctgctacagccaggtgaaccccatcaccctgaccgccgccctcctgctgctcgtggcgcactacgccatcatcgggcccggcctgcaggccaaggccacgcgcgaggcccagaagcgggcggccgccggcatcatgaagaaccccaccgtcgacgggatcaccgtgatcgacctggacccgatcccctacgaccccaagttcgagaagcagctcggccaggtgatgctgctgatcctctgcgtcacccaggtgctgatgatgcgcacgacctgggccctgtgcgaggccctcaccctggcgaccgggcccatctccacgctgtgggagggcaacccggggcggttctggaacaccaccatcgccgtgagcatggccaacatcttccgcggctcctacctcgccggcgccgggctgctgttcagcatcatgaagaacaccacgaacacccggcgcggcaccgggaacatcggcgagaccctcggcgagaagtggaagtcccgcctgaacgcgctggggaagtccgagttccagacgtacaagaagtccggcatccaggaggtcgaccggaccctcgccaaggaggggatcaagcgcggcgagaccgaccaccacgccgtgagccgggggtccgccaagctgcgctggttcgtggagcggaacatggtcacccccgagggcaaggtggtggacctgggctgcgggcgcggcgggtggagctactactgcggcgggctcaagaacgtccgggaggtgaagggcctgacgaagggcgggcccggccacgaggagcccatcccgatgtccacctacgggtggaacctggtgcgcctccagagcggcgtcgacgtgttcttcatcccgcccgagaagtgcgacaccctgctgtgcgacatcggggagtccagccccaacccgaccgtggaggcgggccggacgctccgcgtcctgaacctggtggagaactggctcaacaacaacacccagttctgcatcaaggtgctgaacccctacatgccctccgtcatcgagaagatggaggccctgcagcggaagtacggcggggccctggtgcgcaacccgctcagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctggggagcggcacgcggaacatcgggatcgagtccgagatccccaacctcgacatcatcggcaagcgcatcgagaagatcaagcaggagcacgagaccagctggcactacgaccaggaccacccctacaagacctgggcgtaccacggctcctacgagaccaagcagacggggagcgcctccagcatggtcaacggcgtggtgcggctgctgaccaagccgtgggacgtcctccccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctgtggaaggagctcggcaagaagaagaccccgcggatgtgcacgcgcgaggagttcacccggaaggtgcgctccaacgccgcgctgggggccatcttcaccgacgagaacaagtggaagtccgcccgggaggccgtggaggactcccgcttctgggagctggtcgacaaggagcggaacctccacctggagggcaagtgcgagacctgcgtgtacaacatgatggggaagcgcgagaagaagctgggcgagttcgggaaggccaagggcagccgggcgatctggtacatgtggctcggcgcccgcttcctggagttcgaggccctggggttcctcaacgaggaccactggttctcccgggagaacagcctgtccggcgtcgagggggagggcctgcacaagctcgggtacatcctgcgcgacgtgagcaagaaggagggcggcgccatgtacgcggacgacacggccgggtgggacacccggatcaccctggaggacctcaagaacgaggagatggtgaccaaccacatggagggcgagcacaagaagctggccgaggccatcttcaagctgacgtaccagaacaaggtcgtgcgcgtgcagcggcccacgccccgggggaccgtcatggacatcatcagccggcgcgaccagcggggctccggccaggtggggacctacggcctcaacacgttcaccaacatggaggcccagctgatccgccagatggagggggagggcgtgttcaagaacatccagcacctgaccgtcaccgaggaggtggcggtgcagaactggctcgcccgggtcgggcgcgagcgcctgagccggatggccatctccggcgacgactgcgtggtgaagcccctggacgaccgcttcgccaacgccctcacggcgctgaacgacatgggcaagatccggaaggacatccagcagtgggagccgagcaaggggtggaacgactggacccaggtccccttctgctcccaccacttccacgagctgatcatgaaggacggccgcgtgctcgtggtcccctgccggaaccaggacgagctgatcgggcgcgcccggatcagccagggcgccgggtggtccctgcgcgagaccgcctgcctcggcaagagctacgcccagatgtggtccctgatgtacttccaccggcgcgacctgcggctcgcggccaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctgggcaagcgggaggaccagtggtgcgggtccctcatcggcctgaccagccgcgcgacctgggccaagaacatccaggccgccatcaaccaggtccggtccctgatcgggaacgaggagtacaccgactacatgccgagcatgaagcgcttccggcgcgaggaggaggaggcgggcgtgctctggtga

SEQ ID NO: 9536 - RNA, 9876 nt, synthetic construct
  misc_feature 1..9876: note = derived and/or modified CDS sequence (opt1) from DENV-2__FJ461309__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgaagacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccggaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgggagatcgtggacctcatgtgccacgccaccttcaccatgcgcctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccgcaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccggggcaccgggaacatgggcgagacgctgggcgagaagtggaagtcccgcctgaacgccctcggcaagagcgagttccagatctacaagaagtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgggtgttcaaggagaaggtcgacacccgcacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtggaggacggccggttctgggagctcgtcgacaaggagcgcaacctgcacctggaggggaagtgcgagacctgcgtgtacaacatgatgggcaagcgggagaagaagctcggggagttcggcaaggccaagggctcccgcgccatctggtacatgtggctgggggcgcggttcctggagttcgaggccctcggcttcctgaacgaggaccactggttcagccgcgagaactccctgagcggggtcgagggcgaggggctccacaagctgggctacatcctgcgggacgtgtccaagaaggagggcggggccatgtacgccgacgacacggcgggctgggacacccgcatcaccctcgaggacctgaagaacgaggagatggtgaccaaccacatggagggggagcacaagaagctggccgaggccatcttcaagctcacgtaccagaacaaggtcgtgcgggtgcagcgccccacgccccggggcaccgtcatggacatcatcagccgccgggaccagcgcgggagcggccaggtgggcacctacgggctgaacacgttcaccaacatggaggcccagctgatccggcagatggagggcgagggggtgttcaagaacatccagcacctcaccgtcaccgaggaggtggccgtgcagaactggctggcgcgcgtcggccgggagcgcctgtcccgcatggccatcagcggcgacgactgcgtggtgaagcccctcgacgaccggttcgccaacgccctgacggccctgaacgacatggggaagatccgcaaggacatccagcagtgggagccgtccaagggctggaacgactggacccaggtccccttctgcagccaccacttccacgagctcatcatgaaggacgggcgggtgctggtggtcccctgccgcaaccaggacgagctgatcggccgggcgcgcatctcccagggggccggctggagcctccgggagaccgcctgcctgggcaagtcctacgcccagatgtggagcctgatgtacttccaccgccgggacctccgcctggccgcgaacgccatctgctccgccgtgcccagccactgggtgccgacctcccggacgacctggagcatccacgccaagcacgagtggatgaccaccgaggacatgctgaccgtctggaaccgcgtgtggatccgggagaacccctggatggaggacaagacgcccgtggagtcctgggaggagatcccctacctcgggaagcgcgaggaccagtggtgcggcagcctgatcgggctgacctcccgggccacctgggcgaagaacatccaggccgccatcaaccaggtccgcagcctcatcggcaacgaggagtacaccgactacatgccgtccatgaagcggttccgccgggaggaggaggaggccggggtgctgtggtga

SEQ ID NO: 9537 - RNA, 9876 nt, synthetic construct
  misc_feature 1..9876: note = derived and/or modified CDS sequence (opt1) from DENV-2__FJ461311__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcaacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatgacggacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacatggaggtcgagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtgctgcacaccgccgaggccgggggccgggcgtacaaccacgccctctccgagctgcccgagaccctggagaccctcctgctgctcacgctgctggccaccgtcaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtggtcatcgccatcctgaccgtggtggccgccaccatggcgaacgagatgggcttcctggagaagacgaagaaggacctcgggctgggctccatcgccacccgccagccggagagcaacatcctggacatcgacctccggcccgcctccgcctggaccctgtacgccgtcgcgaccacgttcgtgacccccatgctgcgccacagcatcgagaacagctccgtgaacgtcagcctcaccgccatcgccaaccaggccaccgtgctgatgggcctggggaagggctggcccctctccaagatggacatcggggtgccgctgctggccatcggctgctacagccaggtcaaccccatcacgctcaccgcggccctgctgctcctggtggcccactacgccatcatcgggcccggcctgcaggcgaaggccacccgggaggcccagaagcgcgccgccgcgggcatcatgaagaaccccaccgtggacgggatcacggtcatcgacctcgacccgatcccctacgaccccaagttcgagaagcagctgggccaggtgatgctgctcgtgctgtgcgtcacccaggtgctgatgatgcggaccacctgggccctctgcgaggccctgacgctggccaccgggcccatctccaccctctgggagggcaacccggggcgcttctggaacaccacgatcgccgtgagcatggcgaacatcttccggggctcctacctggccggcgccgggctcctcttcagcatcatgaagaacaccaccaacacccgccgcggcacggggaacatgggcgagaccctgggcgagaagtggaagtcccagctgaacgccctcgggaagtccgagttccagatctacaagaagtccggcatccaggaggtcgaccggaccctggccaaggaggggatcaagcgcggcgagaccgaccaccacgcggtgagccgggggtccgccaagctgcgctggttcgtggagcggaacatggtcacgcccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgacggtggaggccggccggaccctgcgcgtcctgaacctcgtggagaactggctgaacaacaacacccagttctgcatcaaggtgctgaacccctacatgccctccgtcatcgagaagatggaggccctgcagcggaagtacggcggggcgctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacgtacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtcaacggcgtggtgcggctgctcaccaagccgtgggacgtcctgcccaccgtgacgcagatggcgatgaccgacaccacccccttcgggcagcagcgcgtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtcgtgcgcgtgcagcggcccacgccccgggggaccgtcatggacatcatcagccggcgcgaccagcggggctccggccaggtggggacgtacggcctgaacaccttcaccaacatggaggcccagctgatccgccagatggagggggagggcgtgttcaagaacatccagcacctcaccgtcacggaggaggtggccgtgaagaactggctggcccgggtcgggcgcgagcgcctgagccggatggcgatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggccaagaacatccaggcggccatcaaccaggtccggtccctcatcgggaacgaggagtacacggactacatgccgagcatgaagcgcttccggcgcgaggaggaggaggccggcgtgctgtggtga

SEQ ID NO: 9538 - RNA, 9876 nt, synthetic construct
  misc_feature 1..9876: note = derived and/or modified CDS sequence (opt1) from DENV-2__FJ410217__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcatcgtctcctggaagaacaaggagctcaagtgcggcagcggcatcttcgtgaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtggaggactacgggttcggcgtcttcaccaccaacatctggctccggctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcttcgggtacagccagatcggcgccggcgtgtacaaggaggggaccttccacaccatgtggcacgtgacccgcggcgccgtcctgatgcacaaggggaagcggatcgagccctcctgggccgacgtgaagaaggacctcatcagctacggcgggggctggaagctggagggcgagtggaaggagggggaggaggtgcaggtcctggcgctcgagcccggcaagaacccccgcgccgtgcagacgaagcccgggctgttcaagaccaacaccggcaccatcggggccgtgtccctggacttcagccccggcacgtccggcagccccatcatcgacaagaaggggaaggtcgtgggcctctacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctgcccgccatcgtgcgcgaggccatcaagcgggggctccgcaccctgatcctggcgccgacccgggtcgtggccgccgagatggaggaggccctccgcggcctgcccatccggtaccagacccccgccatccgcgcggagcacacggggcgcgagatcgtggacctgatgtgccacgccaccttcaccatgcggctcctgagccccgtccgcgtgccgaactacaacctgatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctccgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctggccgacggggaggagcgcgtcatcctcgccggccccatgccggtgacccacagctccgccgcccagcggcgcgggcggatcggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtggacgccatcgacggcgagtaccgcctgcgcggggaggcccggaagacgttcgtcgacctgatgcgccggggcgacctccccgtgtggctggcctacaaggtggcggccgaggggatcaactacgccgaccgccggtggtgcttcgacggcatcaagaacaaccagatcctggaggagaacgtcgaggtggagatctggaccaaggagggggagcgcaagaagctcaagccgcggtggctggacgcccgcatctactccgaccccctggccctcaaggagttcaaggagttcgcggccggccggaagtccctgaccctgaacctcatcaccgagatgggccgcctgcccacgttcatgacccagaagacccgggacgccctggacaacctcgccgtcctgcacaccgcggaggccgggggccgcgcctacaaccacgccctgtccgagctccccgagacgctggagaccctgctcctgctgaccctcctggccaccgtgaccggcgggatcttcctgttcctcatgagcgggcgggggatcggcaagatgaccctggggatgtgctgcatcatcaccgcgtccatcctgctctggtacgcccagatccagccgcactggatcgccgccagcatcatcctggagttcttcctgatcgtgctcctgatccccgagcccgagaagcagcgcacgccccaggacaaccagctgacctacgtcgtgatcgccatcctcacggtggtcgcggccaccatggccaacgagatgggcttcctggagaagaccaagaaggacctggggctcggctccatcgccacccagcagccggagagcaacatcctggacatcgacctgcggcccgcctccgcgtggacgctctacgccgtggccaccaccttcgtgacccccatgctgcgccacagcatcgagaacagctccgtcaacgtgagcctgacggccatcgccaaccaggcgaccgtgctcatgggcctggggaagggctggcccctgtccaagatggacatcggggtcccgctcctggccatcggctgctacagccaggtgaaccccatcaccctgaccgccgccctcctgctgctcgtggcgcactacgccatcatcgggcccggcctgcaggccaaggccacgcgggaggcccagaagcgcgcggccgccggcatcatgaagaaccccaccgtcgacgggatcaccgtgatcgacctggacccgatcccctacgaccccaagttcgagaagcagctcggccaggtgatgctgctgatcctctgcgtcacccaggtgctgatgatgcggacgacctgggccctgtgcgaggccctcaccctggcgaccgggcccatctccacgctgtgggagggcaacccggggcgcttctggaacaccaccatcgccgtgagcatggccaacatcttccggggctcctacctcgccggcgccgggctgctgttcagcatcatgaagaacaccacgaacgcgcgccgcggcaccgggaacatgggcgagaccctcggcgagaagtggaagtcccggctgaacgccctgggcaagagcgagttccagatctacaagaagtccggcatccaggaggtcgaccgcaccctcgccaaggaggggatcaagcggggcgagacggaccaccacgccgtgagccgcgggtccgcgaagctgcggtggttcgtggagcgcaacatggtcacccccgagggcaaggtggtggacctgggctgcgggcggggcgggtggagctactactgcggcgggctcaagaacgtccgcgaggtgaagggcctgaccaagggcgggcccggccacgaggagcccatcccgatgtccacctacgggtggaacctggtgcggctccagagcggcgtcgacgtgttcttcatcccgcccgagaagtgcgacacgctgctgtgcgacatcggggagtccagccccaacccgaccgtggaggccggccgcaccctccgggtcctgaacctggtggagaactggctcaacaacaacacccagttctgcatcaaggtgctgaacccctacatgccctccgtcatcgagaagatggaggccctgcagcgcaagtacggcggggccctggtgcggaacccgctcagccgcaacagcacgcacgagatgtactgggtgtccaacgccagcggcaacatcgtctccagcgtgaacatgatctcccggatgctgatcaaccgcttcaccatgcggcacaagaaggcgacctacgagcccgacgtggacctggggagcggcacccgcaacatcgggatcgagtccgagatccccaacctcgacatcatcggcaagcggatcgagaagatcaagcaggagcacgagaccagctggcactacgaccaggaccacccctacaagacgtgggcctaccacggctcctacgagaccaagcagaccgggagcgcctccagcatggtcaacggcgtggtgcgcctgctgaccaagccgtgggacgtcctccccacggtgacccagatggccatgaccgacaccacgcccttcgggcagcagcgcgtgttcaaggagaaggtcgacacccggacccaggagcccaaggagggcaccaagaagctgatgaagatcacggccgagtggctgtggaaggagctcggcaagaagaagaccccgcgcatgtgcacccgggaggagttcacccgcaaggtgcggtccaacgcggccctgggggccatcttcacggacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggcgaagggcagccgcgccatctggtacatgtggctcggcgcccggttcctggagttcgaggccctggggttcctcaacgaggaccactggttctcccgcgagaacagcctgtccggcgtcgagggggagggcctgcacaagctcgggtacatcctgcgggacgtgagcaagaaggagggcggcgcgatgtacgccgacgacaccgccgggtgggacacccgcatcacgctggaggacctcaagaacgaggagatggtgaccaaccacatggagggcgagcacaagaagctggccgaggccatcttcaagctgacctaccagaacaaggtcgtgcgggtgcagcgccccacgccccgggggacggtcatggacatcatcagccgccgggaccagcgcggctccggccaggtgggcacctacggcctcaacaccttcaccaacatggaggcgcagctgatccggcagatggagggggagggcgtgttcaagaacatccagcacctgacggtcaccgaggaggtggccgtgcagaactggctcgcccgcgtcgggcgcgagcggctgagccgcatggccatctccggcgacgactgcgtggtgaagcccctggacgaccggttcgccaacgcgctcaccgccctgaacgacatgggcaagatccgcaaggacatccagcagtgggagccgagcaaggggtggaacgactggacccaggtccccttctgctcccaccacttccacgagctgatcatgaaggacggccgggtgctcgtggtcccctgccgcaaccaggacgagctgatcgggcgggcccgcatcagccagggcgccgggtggtccctgcgggagacggcctgcctcggcaagagctacgcgcagatgtggtccctgatgtacttccaccgccgggacctgcgcctcgccgccaacgccatctgcagcgccgtgccctcccactgggtgccgaccagccggaccacctggtccatccacgcgaagcacgagtggatgacgaccgaggacatgctgaccgtctggaaccgcgtgtggatccgggagaacccctggatggaggacaagacccccgtggagagctgggaggagatcccctacctgggcaagcgcgaggaccagtggtgcgggtccctcatcggcctgaccagccgggccacgtgggccaagaacatccaggccgcgatcaaccaggtccgctccctgatcgggaacgaggagtacaccgactacatgccgagcatgaagcggttccgccgcgaggaggaggaggccggcgtgctctggtga

SEQ ID NO: 9539 - RNA, 9876 nt, synthetic construct
  misc_feature 1..9876: note = derived and/or modified CDS sequence (opt1) from DENV-2__FJ410219__SS-prME
  source 1..9876: mol_type = other RNA
agcgccgggatgatcatcatgctgatccccaccgtgatggccttccacctcaccacccggaacggggagccgcacatgatcgtcggcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacggcacgtgcaccaccaccggcgagcaccgccgggagaagcgcagcgtcgccctggtgccccacgtggggatgggcctcgagacgcggaccgagacctggatgagcagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctcttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatcctgatgagctccgggaacctcctgttcaccggccacctgaagtgccggctccgcatggacaagctgcagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctcgagaagcgctacgtcctgggccggctgatcaccgtgaacccgatcgtgacggagaaggactcccccgtcaacatcgaggccgagccgcccttcggggacagctacatcatcatcggcgtggagccggggcagctcaagctgaactggttcaagaagggctccagcatcgggcagatgttcgagaccaccatgcgcggcgcgaagcgcatggccatcctgggcgacaccgcctgggacttcgggtccctcggcggggtgttcacgagcatcggcaaggccctgcaccaggtcttcggggccatctacggcgcggccttctccggcgtgagctggaccatgaagatcctgatcggggtgatcatcacctggatcggcatgaactcccggagcacctccctgagcgtctccctcgtgctggtggggatcgtcacgctgtacctcggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctcgagaacctgatgtggaagcagatcacccccgagctgaaccacatcctcgccgagaacgaggtgaagctgaccatcatgaccggggacatcaagggcatcatgcaggccgggaagcgcttcctgcggccgcagcccacggagctcaagtacagctggaagacctggggcaaggccaagatgctgtccaccgagagctacaaccagaccttcctgatcgacggccccgagacggcggagtgcccgaacaccaaccgcgcctggaactccctcgaggtggaggactacgggttcggcgtcttcaccaccaacatctggctgaagctgaaggagaagcaggacgccttctgcgacagcaagctcatgtccgccgccatcaaggacaaccgggcggtgcacgccgacatggggtactggatcgagagcgccctgaacgacacgtggaagatcgagaaggcctccttcatcgaggtgaagaactgccactggcccaagagccacaccctgtggtccaacggcgtcctcgagagcgagatgatcatccccaagaacctggccggccccgtgtcccagcacaactaccgcccggggtaccacacccagatcgcgggcccctggcacctggggaagctcgagatggacttcgacttctgcgacggcaccaccgtgatcgtcacggaggactgcgggaaccggggccccagcctgcgcaccaccaccgcctccggcaagctgatcacggagtggtgctgccggagctgcaccctcccgcccctgcgctaccgcggggaggacggctgctggtacgggatggagatccgccccctgaaggagaaggaggagaacctcgtgaacagcctggtgaccgccggccacgggcaggtcgacaacttctccctgggcgtgctcggcatggccctgttcctggaggagatgctccggacccgcgtggggatgaagcacgcgatcctgctggtcgccgtgagcttcgtgacgctcatcaccggcaacatgtccttcaaggacctggggcgggtcgtggtgatggtcggcgccaccatgaccgacgacatcgggatgggcgtgacgtacctggccctcctggccgcgttcaaggtgcgccccaccttcgccgccggcctgctcctgcggaagctgaccagcaaggagctcatgatgatcaccatcgggatcgtcctgctgtcccagagcacgatccccgagaccgtgctcgagctgaccgacgccctggccctcggcatgatggtgctgaagatcgtccgcaacatggagaagtaccagctggcggtgaccatcatggccatcctctgcgtccccaacgccgtgatcctgcagaacgcctggaaggtgtcctgcacgatcctggccgtcgtgagcgtgagccccctcctgctgaccagctcccagcagaagaccgactggatccccctcgcgctgaccatcaaggggctgaaccccacggccatcttcctcaccaccctgagccgcaccaacaagaagcggtcctggccgctgaacgaggccatcatggccgtcggcatggtgagcatcctcgcgtccagcctgctgaagaacgacatccccatgacgggccccctcgtggccgggggcctgctgaccgtctgctacgtgctcaccgggcgctccgccgacctggagctggagcgggtgaccgacgtcaagtgggaggaccaggccgagatcagcggctccagccccatcctcagcatcacgatctccgaggacgggagcatgtccatcaagaacgaggaggaggagcagaccctgaccatcctgatccgcaccggcctcctggtgatcagcggcctgttcccgatctccatccccatcacggccgcggcctggtacctctgggaggtgaagaagcagcgggccggggtcctgtgggacgtgccctccccgccgcccatgggcaaggccgagctggaggacggggcctaccgcatcaagcagaagggcatcctcgggtactcccagatcggcgcgggcgtgtacaaggaggggaccttccacaccatgtggcacgtcacccggggcgccgtgctgatgcacaaggggaagcgcatcgagcccagctgggccgacgtgaagaaggacctgatctcctacggcgggggctggaagctcgagggcgagtggaaggagggggaggaggtccaggtgctggccctggagcccggcaagaacccccgggccgtgcagaccaagcccggcctcttcaagacgaacaccggcaccatcggggcggtcagcctggacttctcccccggcaccagcggctcccccatcatcgacaagaaggggaaggtggtgggcctgtacgggaacggcgtcgtgacgcgcagcggcgcctacgtgtccgccatcgcccagaccgagaagtccatcgaggacaaccccgagatcgaggacgacatcttccggaagcgccggctgaccatcatggacctccaccccggggccggcaagaccaagcgctacctgcccgcgatcgtccgggaggccatcaagcgcgggctgcggacgctcatcctggccccgacccgcgtggtggccgcggagatggaggaggccctgcggggcctccccatccgctaccagacccccgccatccgggccgagcacaccgggcgcgagatcgtcgacctgatgtgccacgccacgttcaccatgcgcctgctctcccccgtgcgggtgccgaactacaacctgatcatcatggacgaggcgcacttcaccgaccccgccagcatcgccgcccgcggctacatctccacccgggtcgagatgggcgaggccgcggggatcttcatgacggccacgccgcccggcagccgcgacccgttcccccagagcaacgcccccatcatcgacgaggagcgggagatccccgagcgctcctggaacagcgggcacgagtgggtgaccgacttcaagggcaagaccgtgtggttcgtcccgtccatcaaggccgggaacgacatcgccgcgtgcctgcggaagaacggcaagaaggtgatccagctcagccgcaagacgttcgactccgagtacgtgaagacccggaccaacgactgggacttcgtcgtgaccacggacatcagcgagatgggcgccaacttcaaggccgagcgcgtgatcgacccccggcgctgcatgaagcccgtcatcctgaccgacggggaggagcgggtgatcctggccggccccatgccggtgacccactccagcgcggcccagcgccgggggcgcatcggccggaaccccaagaacgagaacgaccagtacatctacatgggggagcccctcgagaacgacgaggactgcgcccactggaaggaggccaagatgctgctggacaacatcaacacccccgagggcatcatcccgtccatgttcgagcccgagcgcgagaaggtcgacgccatcgacggcgagtaccggctccgcggggaggcgcgcaagacgttcgtggacctgatgcggcgcggcgacctgcccgtgtggctcgcctacaaggtcgccgccgaggggatcaactacgccgaccggcgctggtgcttcgacggcatcaagaacaaccagatcctggaggagaacgtggaggtcgagatctggaccaaggagggggagcggaagaagctgaagccgcgctggctcgacgcgcggatctacagcgaccccctggccctgaaggagttcaaggagttcgccgccggccgcaagtccctcaccctgaacctgatcaccgagatgggccggctccccacgttcatgacccagaagacccgcgacgccctggacaacctggcggtgctccacaccgccgaggccgggggccgggcctacaaccacgcgctgagcgagctgcccgagacgctcgagaccctgctgctcctgaccctgctcgccaccgtgaccggcgggatcttcctgttcctgatgtccgggcgcgggatcggcaagatgaccctcgggatgtgctgcatcatcaccgccagcatcctgctgtggtacgcccagatccagccgcactggatcgccgcgtccatcatcctcgagttcttcctgatcgtcctgctcatccccgagcccgagaagcagcggacgccccaggacaaccagctgacctacgtggtgatcgccatcctgacggtcgtggccgccaccatggccaacgagatgggcttcctcgagaagaccaagaaggacctggggctgggcagcatcgcgacccagcagccggagtccaacatcctcgacatcgacctgcgccccgccagcgcctggacgctgtacgccgtggccaccaccttcgtcacccccatgctccggcactccatcgagaacagcagcgtgaacgtgtccctgacggcgatcgccaaccaggccaccgtcctgatgggcctcgggaagggctggcccctgagcaagatggacatcggggtgccgctgctcgccatcggctgctactcccaggtgaaccccatcaccctgaccgccgcgctgctcctgctggtcgcccactacgccatcatcgggcccggcctccaggccaaggcgacgcgcgaggcccagaagcgggccgccgccggcatcatgaagaaccccaccgtggacgggatcaccgtgatcgacctggacccgatcccctacgaccccaagttcgagaagcagctgggccaggtcatgctcctgatcctgtgcgtgacccaggtgctcatgatgcgcacgacctgggcgctgtgcgaggccctgaccctcgccaccgggcccatcagcacgctgtgggagggcaacccggggcggttctggaacaccaccatcgccgtctccatggccaacatcttccgcggcagctacctggcgggcgccgggctcctgttctccatcatgaagaacaccacgaacacccggcgcggcaccgggaacatgggcgagaccctgggcgagaagtggaagtcccgcctcaacgccctggggaagtccgagttccagatctacaagaagtccggcatccaggaggtggaccggacgctggccaaggaggggatcaagcgcggcgagaccgaccaccacgccgtgtcccgggggagcgcgaagctccgctggttcgtcgagcggaacatggtgacccccgagggcaaggtggtcgacctgggctgcgggcgcggcgggtggtcctactactgcggcgggctgaagaacgtgcgggaggtgaagggcctcaccaagggcgggcccggccacgaggagcccatcccgatgagcacgtacgggtggaacctggtccgcctgcagtccggcgtggacgtgttcttcatcccgcccgagaagtgcgacaccctcctgtgcgacatcggggagagctcccccaacccgaccgtcgaggccggccggaccctgcgcgtgctcaacctggtggagaactggctgaacaacaacacgcagttctgcatcaaggtcctgaacccctacatgcccagcgtgatcgagaagatggaggccctccagcggaagtacggcggggccctggtgcgcaacccgctgtcccggaacagcacccacgagatgtactgggtcagcaacgcgtccggcaacatcgtgagctccgtgaacatgatcagccgcatgctcatcaaccggttcaccatgcgccacaagaaggccacctacgagcccgacgtcgacctggggtccggcacccggaacatcgggatcgagagcgagatccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtggtccggctcctgacgaagccgtgggacgtgctgcccaccgtgacccagatggccatgaccgacacgacccccttcgggcagcagcgcgtcttcaaggagaaggtggacacccgcacccaggagcccaaggagggcacgaagaagctcatgaagatcaccgcggagtggctgtggaaggagctgggcaagaagaagaccccgcggatgtgcacccgcgaggagttcacgcggaaggtgcgcagcaacgccgccctcggggccatcttcaccgacgagaacaagtggaagtccgcccgggaggcggtcgaggacagccgcttctgggagctggtggacaaggagcggaacctgcacctcgagggcaagtgcgagacctgcgtctacaacatgatggggaagcgcgagaagaagctgggcgagttcgggaaggccaagggctcccgggccatctggtacatgtggctgggcgcccgcttcctcgagttcgaggccctggggttcctgaacgaggaccactggttcagccgggagaactccctcagcggcgtggagggggagggcctgcacaagctggggtacatcctccgcgacgtgtccaagaaggagggcggcgcgatgtacgccgacgacaccgccgggtgggacacgcggatcaccctggaggacctgaagaacgaggagatggtcaccaaccacatggagggcgagcacaagaagctcgccgaggcgatcttcaagctgacctaccagaacaaggtggtgcgcgtccagcggcccacgccccgcgggaccgtgatggacatcatcagccggcgcgaccagcggggcagcggccaggtggggacctacggcctgaacaccttcacgaacatggaggcccagctcatccgccagatggagggggagggcgtcttcaagaacatccagcacctgaccgtgaccgaggaggtggccgtcaagaactggctggcccgggtggggcgcgagcgcctctcccggatggccatcagcggcgacgactgcgtggtcaagcccctggacgaccgcttcgcgaacgccctgaccgccctcaacgacatgggcaagatccggaaggacatccagcagtgggagccgtccaaggggtggaacgactggacccaggtgcccttctgcagccaccacttccacgagctgatcatgaaggacggccgcgtgctggtcgtgccctgccggaaccaggacgagctcatcgggcgcgcccggatctcccagggcgccgggtggagcctgcgcgagaccgcgtgcctgggcaagtcctacgcccagatgtggagcctcatgtacttccaccggcgcgacctgcggctggccgccaacgccatctgctccgcggtgcccagccactgggtcccgacctcccgcaccacgtggagcatccacgccaagcacgagtggatgaccaccgaggacatgctcaccgtgtggaaccgggtgtggatccgcgagaacccctggatggaggacaagacccccgtcgagtcctgggaggagatcccctacctgggcaagcgggaggaccagtggtgcgggagcctgatcggcctcacgtcccgcgccacctgggccaagaacatccaggccgcgatcaaccaggtgcggagcctgatcgggaacgaggagtacaccgactacatgccgtccatgaagcgcttccggcgcgaggaggaggaggccggcgtgctgtggtga

SEQ ID NO: 9540 - RNA, 9876 nt, synthetic construct
  misc_feature 1..9876: note = derived and/or modified CDS sequence (opt1) from DENV-2__FJ461314__SS-prME
  source 1..9876: mol_type = other RNA
agcgcggggatgatcatcatgctgatccccaccgtgatggccttccacctcaccacccggaacggggagccgcacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccctgaagatcctgatcggggtgatcatcacctggatcggcatgaactcccggagcacctccctgagcgtctccctcgtgctggtggggatcgtcacgctgtacctcggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctcgagaacctgatgtggaagcagatcacccccgagctgaaccacatcctcgccgagaacgaggtgaagctgaccatcatgaccggggacatcaagggcatcatgcaggccgggaagcgcagcctgcggccgcagcccacggagctcaagtactcctggaagacctggggcaaggccaagatgctgagcaccgagtcctacaaccagaccttcctgatcgacggccccgagacggcggagtgcccgaacaccaaccgcgcctggaacagcctcgaggtggaggactacgggttcggcgtcttcaccaccaacatctggctgaagctgaaggagaagcaggacgccttctgcgactccaagctcatgagcgccgccatcaaggacaaccgggcggtgcacgccgacatggggtactggatcgagtccgccctgaacgacacgtggaagatcgagaaggccagcttcatcgaggtgaagaactgccactggcccaagtcccacaccctgtggagcaacggcgtcctcgagtccgagatgatcatccccaagaacctggccggccccgtgagccagcacaactaccgcccggggtaccacacccagatcgcgggcccctggcacctggggaagctcgagatggacttcgacttctgcgacggcaccaccgtgatcgtcacggaggactgcgggaaccggggcccctccctgcgcaccaccaccgccagcggcaagctgatcacggagtggtgctgccggagctgcaccctcccgcccctgcgctaccgcggggaggacggctgctggtacgggatggagatccgccccctgaaggagaaggaggagaacctcgtgaactccctggtgaccgccggccacgggcaggtcgacaacttcagcctgggcgtgctcggcatggccctgttcctggaggagatgctccggacccgcgtggggacgaagcacgcgatcctgctggtcgccgtgtccttcgtgaccctcatcaccggcaacatgagcttcaaggacctggggcgggtcgtggtgatggtcggcgccaccatggccgacgacatcgggatgggcgtgacgtacctggccctcctggcggccttcaaggtgcgccccaccttcgccgccggcctgctcctgcggaagctgacctccaaggagctcatgatgaccacgatcgggatcgtcctgctgagccagtccaccatccccgagaccgtgctcgagctgaccgacgccctggcgctcggcatgatggtgctgaagatcgtccgcaacatggagaagtaccagctggccgtgacgatcatggccatcctctgcgtccccaacgccgtgatcctgcagaacgcctggaaggtgagctgcaccatcctggcggtcgtgtccgtgagccccctcctgctgacctccagccagcagaagaccgactggatccccctcgccctgacgatcaaggggctgaaccccaccgccatcttcctcaccaccctgtcccgcacgaacaagaagcggagctggccgctgaacgaggccatcatggcggtcggcatggtgtccatcctcgccagctccctgctgaagaacgacatccccatgaccggccccctcgtggccgggggcctgctgaccgtctgctacgtgctcaccgggcgcagcgccgacctggagctggagcgggccacggacgtgaagtgggaggaccaggcggagatctccggcagcagccccatcctctccatcaccatcagcgaggacgggtccatgagcatcaagaacgaggaggaggagcagaccctgaccatcctgatccgcacgggcctcctggtcatctccggcctgttcccgatcagcatccccatcaccgccgccgcctggtacctctgggaggtgaagaagcagcgggccggggtgctgtgggacgtccccagcccgccgcccatgggcaaggcggagctggaggacggggcctaccgcatcaagcagaagggcatcctcgggtacagccagatcggcgccggcgtgtacaaggaggggaccttccacaccatgtggcacgtgacccggggcgccgtcctgatgcacaaggggaagcgcatcgagccctcctgggccgacgtgaagaaggacctgatcagctacggcgggggctggaagctcgagggcgagtggaaggagggggaggaggtgcaggtcctggcgctggagcccggcaagaacccccgggccgtgcagacgaagcccggcctcttcaagaccaacaccggcaccatcggggccgtgtccctggacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctccaccccggggccggcaagacgaagcgctacctgcccgccatcgtgcgggaggccatcaagcgcgggctgcggaccctcatcctggcgccgacccgcgtcgtggccgccgagatggaggaggccctgcggggcctccccatccgctaccagacccccgccatccgggcggagcacacggggcgcgagatcgtggacctgatgtgccacgccaccttcaccatgcgcctgctcagccccgtccgggtgccgaactacaacctgatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctctcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctgaccgacggggaggagcgggtcatcctggccggccccatgccggtgacccacagctccgccgcccagcgccgggggcgcatcggccggaaccccaagaacgagaacgaccagtacatctacatgggggagcccctcgagaacgacgaggactgcgcccactggaaggaggcgaagatgctgctggacaacatcaacacgcccgagggcatcatcccgagcatgttcgagcccgagcgcgagaaggtggacgccatcgacggcgagtaccggctccgcggggaggcccgcaagaccttcgtcgacctgatgcggcgcggcgacctgcccgtgtggctcgcctacaaggtggccgcggaggggatcaactacgccgaccggcgctggtgcttcgacggcatcaagaacaaccagatcctggaggagaacgtcgaggtggagatctggaccaaggagggggagcggaagaagctgaagccgcgctggctcgacgcccggatctactccgaccccctggccctgaaggagttcaaggagttcgccgcgggccgcaagagcctcaccctgaacctgatcacggagatgggccggctccccaccttcatgacccagaagacccgcgacgccctggacaacctggccgtcctccacacggccgaggccggcgggcgggcctacaaccacgccctgtccgagctgcccgagaccctcgagaccctgctgctcctgaccctgctcgccacggtgaccgggggcatcttcctgttcctgatgagcggccgcgggatcggcaagatgaccctcgggatgtgctgcatcatcaccgcctccatcctgctgtggtacgcgcagatccagccgcactggatcgccgccagcatcatcctcgagttcttcctgatcgtgctgctcatccccgagcccgagaagcagcggacgccccaggacaaccagctgacgtacgtcgtgatcgccatcctgaccgtggtcgccgcgaccatggccaacgagatgggcttcctcgagaagaccaagaaggacctggggctgggctccatcgccacgcagcagccggagagcaacatcctcgacatcgacctgcgccccgcctccgcctggaccctgtacgcggtggccaccaccttcgtgacgcccatgctccggcacagcatcgagaacagctccgtcaacgtgagcctgaccgccatcgccaaccaggccaccgtgctgatgggcctcgggaagggctggcccctgtccaagatggacatcggggtcccgctgctcgcgatcggctgctacagccaggtgaaccccatcaccctgacggccgccctgctcctgctggtggcccactacgcgatcatcgggcccggcctccaggccaaggccacccgcgaggcccagaagcgggccgcggccggcatcatgaagaaccccaccgtcgacgggatcaccgtgatcgacctggacccgatcccctacgaccccaagttcgagaagcagctgggccaggtgatgctcctgatcctgtgcgtcacccaggtgctcatgatgcgcaccacctgggccctgtgcgaggccctgaccctcgccacggggcccatctccaccctgtgggagggcaacccggggcggttctggaacaccaccatcgcggtgagcatggccaacatcttccgcggctcctacctggccggcgccgggctcctgttcagcatcatgaagaacacgaccaacacccggcgcggcaccgggaacatgggcgagacgctgggcgagaagtggaagtcccgcctcaacaccctgggcaagagcgagttccagatctacaagaagtccgggatccaggaggtcgaccggaccctggccaaggaggggatcaagcgcggcgagaccgaccaccacgcggtgagccgggggtccgccaagctccgctggttcgtggagcggaacatggtcacgcccgagggcaaggtggtggacctgggctgcgggcgcggcgggtggagctactactgcggcgggctgaagaacgtccgggaggtgaagggcctcaccaagggcgggcccggccacgaggagcccatcccgatgtccacctacgggtggaacctggtgcgcctgcagagcggcgtcgacgtgttcttcatcccgcccgagaagtgcgacaccctcctgtgcgacatcggggagtccagccccaacccgacggtggaggccggccggaccctgcgcgtcctcaacctggtggagaactggctgaacaacaacacccagttctgcatcaaggtgctgaacccctacatgccctccgtcatcgagaagatggaggccctccagcggaagtacggcggggcgctggtgcgcaacccgctgagccggaacagcacccacgagatgtactgggtgtccaacgccagcggcaacatcgtctccagcgtgaacatgatctcccgcatgctcatcaaccggttcaccatgcgccacaagaaggccacgtacgagcccgacgtggacctggggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtcaacggcgtggtgcggctcctgaccaagccgtgggacgtcctgcccaccgtgacgcagatggcgatgaccgacaccacccccttcgggcagcagcgcgtgttcaaggagaaggtcgacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgctccaacgccgccctcggggccatcttcaccgacgagaacaagtggaagtccgcgcgggaggccgtggaggactcccgcttctgggagctggtcgacaaggagcggaacctgcacctcgagggcaagtgcgagacgtgcgtgtacaacatgatggggaagcgcgagaagaagctgggcgagttcgggaaggccaagggcagccgggccatctggtacatgtggctgggcgcccgcttcctcgagttcgaggcgctggggttcctgaacgaggaccactggttctcccgggagaacagcctctccggcgtcgagggggagggcctgcacaagctggggtacatcctccgcgacgtgagcaagaaggagggcggcgccatgtacgccgacgacaccgccgggtgggacacccggatcaccctggaggacctgaagaacgaggagatggtgacgaaccacatggagggcgagcacaagaagctcgcggaggccatcttcaagctgacctaccagaacaaggtcgtgcgcgtgcagcggcccacgccccgcgggaccgtcatggacatcatcagccggcgcgaccagcggggctccggccaggtggggacctacggcctgaacaccttcaccaacatggaggcccagctcatccgccagatggagggggagggcgtgttcaagaacatccagcacctgaccgtcacggaggaggtggccgtgcagaactggctggcccgggtcgggcgcgagcgcctcagccggatggcgatctccggcgacgactgcgtggtgaagcccctggacgaccgcttcgccaacgccctgaccgccctcaacgacatgggcaagatccggaaggacatccagcagtgggagccgagcaaggggtggaacgactggacccaggtccccttctgctcccaccacttccacgagctgatcatgaaggacggccgcgtgctggtggtcccctgccggaaccaggacgagctcatcgggcgcgcccggatcagccagggcgcggggtggtccctgcgcgagaccgcctgcctgggcaagagctacgcccagatgtggtccctcatgtacttccaccggcgcgacctgcggctggccgccaacgcgatctgcagcgccgtgccctcccactgggtgccgacgagccgcaccacctggtccatccacgccaagcacgagtggatgaccaccgaggacatgctcacggtctggaaccgggtgtggatccgcgagaacccctggatggaggacaagacccccgtggagagctgggaggagatcccctacctgggcaagcgggaggaccagtggtgcgggtccctgatcggcctcaccagccgcgccacctgggccaagaacatccaggcggccatcaaccaggtccggtccctgatcgggaacgaggagtacacggactacatgccgagcatgaagcgcttccggcgcgaggaggaggaggccggcgtgctgtggtga

SEQ ID NO: 9541 - RNA, 9876 nt, synthetic construct
  misc_feature 1..9876: note = derived and/or modified CDS sequence (opt1) from DENV-2__FJ410221__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccatcatggccgacgacatcgggatcggcgtgacctacctggccctgctcgcggccttcaaggtgcgccccacgttcgccgccggcctgctgctccggaagctgacctccaaggagctgatgatgaccaccatcgggatcgtcctcctgagccagtccacgatccccgagaccgtgctggagctcaccgacgccctggcgctgggcatgatggtgctcaagatcgtccgcaacatggagaagtaccagctggccgtgaccatcatggccatcctgtgcgtcccgaacgccgtgatcctccagaacgcctggaaggtgagctgcacgatcctggcggtcgtgtccgtgagccccctgctcctgacctccagccagcagaagaccgactggatccccctggccctcaccatcaaggggctgaaccccacggccatcttcctgaccaccctctcccgcaccaacaagaagcggagctggccgctgaacgaggccatcatggcggtcggcatggtgtccatcctggccagctccctcctgaagaacgacatccccatgacgggccccctggtggccgggggcctcctgaccgtctgctacgtgctgaccgggcgcagcgccgacctcgagctggagcgggccaccgacgtgaagtgggaggaccaggcggagatctccggcagcagccccatcctgtccatcacgatcagcgaggacgggtccatgagcatcaagaacgaggaggaggagcagaccctcaccatcctgatccgcaccggcctgctcgtcatctccggcctgttcccgatcagcatccccatcacggccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagaccaagcccgggctgttcaagacgaacaccggcaccatcggggccgtgtccctcgacttcagccccggcacctccggcagccccatcatcgacaagaaggggaaggtcgtgggcctgtacgggaacggcgtggtcacgcgctccggcgcctacgtgagcgccatcgcgcagtccgagaagtccatcgaggacaaccccgagatcgaggacgacatcttccggaagcgccggctgaccatcatggacctgcaccccggggccggcaagaccaagcgctacctccccgccatcgtgcgggaggccatcaagcgcgggctgcggaccctgatcctcgcgccgacgcgcgtcgtggccgccgagatggaggaggccctgcggggcctgcccatccgctaccagacccccgccatccgggtggagcacaccgggcgcgagatcgtcgacctcatgtgccacgcgaccttcacgatgcgcctgctgtcccccgtgcgggtgccgaactacaacctcatcatcatggacgaggcccacttcaccgaccccgccagcatcgccgcccgcggctacatcagcacccgggtcgagatgggcgaggcggccgggatcttcatgaccgccacgccgcccggctcccgcgacccgttcccccagagcaacgcccccatcatcgacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagaccttcgactccgagtacgtgaagacgcggaccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtcgacgcgatcgacggcgagtaccggctgcgcggggaggcccgcaagaccttcgtggacctcatgcggcgcggcgacctgcccgtgtggctggcctacaaggtcgccgccgaggggatcaactacgcggaccggcgctggtgcttcgacggcatcaagaacaaccagatcctcgaggagaacgtggaggtcgagatctggacgaaggagggggagcggaagaagctgaagccgcgctggctggacgcccggatctacagcgaccccctcgccctgaaggagttcaaggagttcgccgccggccgcaagtccctgaccctcaacctgatcaccgagatgggccggctgcccaccttcatgacgcagaagacccgcgacgcgctcgacaacctggccgtgctgcacaccgccgaggccgggggccgggcgtacaaccacgccctcagcgagctgcccgagaccctggagacgctcctgctgctcaccctgctggccaccgtgaccgggggcatcttcctcttcctgatgtccggccgcgggatcggcaagatgacgctggggatgtgctgcatcatcaccgccagcatcctcctgtggtacgcccagatccagccgcactggatcgcggcctccatcatcctggagttcttcctcatcgtcctgctgatccccgagcccgagaagcagcggacgccccaggacaaccagctcacctacgtggtgatcgccatcctgaccgtcgtggccgccacgatggcgaacgagatgggcttcctggagaagaccaagaaggacctcgggctgggcagcatcgccacccagcagccggagtccaacatcctggacatcgacctccgccccgccagcgcctggaccctgtacgccgtggcgacgaccttcgtcacccccatgctgcggcacagcatcgagaactccagcgtgaacgtgtccctcaccgccatcgccaaccaggccacggtcctgatgggcctggggaagggctggcccctcagcaagatggacatcggggtgccgctgctggccatcggctgctactcccaggtgaaccccatcaccctcaccgcggccctgctgctcctggtcgcccactacgccatcatcgggcccggcctgcaggcgaaggccacccgcgaggcccagaagcgggccgccgcgggcatcatgaagaaccccacggtggacgggatcaccgtgatcgacctcgacccgatcccctacgaccccaagttcgagaagcagctgggccaggtcatgctgctcatcctgtgcgtgacccaggtgctgatgatgcgcaccacgtgggccctctgcgaggccctgaccctggccaccgggcccatcagcaccctctgggagggcaacccggggcggttctggaacacgaccatcgccgtctccatggcgaacatcttccgcggcagctacctggccggcgccgggctcctcttctccatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtggaccggaccctggccaaggaggggatcaagcgcggcgagacggaccaccacgcggtgtcccgggggagcgccaagctgcgctggttcgtcgagcggaacatggtgacccccgagggcaaggtggtcgacctcggctgcgggcgcggcgggtggtcctactactgcggcgggctgaagaacgtgcgggaggtgaagggcctgaccaagggcgggcccggccacgaggagcccatcccgatgagcacctacgggtggaacctcgtccgcctgcagtccggcgtggacgtgttcttcatcccgcccgagaagtgcgacacgctgctctgcgacatcggggagagctcccccaacccgaccgtcgaggccggccggaccctgcgcgtgctgaacctcgtggagaactggctgaacaacaacacccagttctgcatcaaggtcctgaacccctacatgcccagcgtgatcgagaagatggaggccctgcagcggaagtacggcggggcgctcgtgcgcaacccgctgagccggaactccacgcacgagatgtactgggtcagcaacgcctccggcaacatcgtgagctccgtgaacatgatcagccgcatgctgatcaaccggttcaccatgcgccacaagaaggccacctacgagcccgacgtcgacctcgggtccggcacccggaacgtggggatcgagagcgagatccccaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtgaacggcgtcgtgcggctgctcaccaagccgtgggacgtgctgcccacggtcacccagatggcgatgaccgacaccacgcccttcgggcagcagcgcgtgttcaaggagaaggtggacacccgcacccaggagcccaaggagggcaccaagaagctgatgaagatcacggccgagtggctctggaaggagctgggcaagaagaagaccccgcggatgtgcacccgcgaggagttcacccggaaggtccgcagcaacgccgccctgggggccatcttcacggacgagaacaagtggaagtccgcgcgggaggccgtggaggacagccgcttctgggagctcgtcgacaaggagcggaacctgcacctggagggcaagtgcgagacctgcgtgtacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtggagggggagggcctccacaagctggggtacatcctgcgcgacgtcagcaagaaggagggcggcgccatgtacgccgacgacaccgccgggtgggacacccggatcacgctcgaggacctgaagaacgaggagatggtgaccaaccacatggagggcgagcacaagaagctggcggaggccatcttcaagctcacctaccagaacaaggtggtccgcgtgcagcggcccacgccccgggggacggtgatggacatcatctcccggcgcgaccagcggggcagcgggcaggtcggcacctacggcctgaacaccttcaccaacatggaggcccagctgatccgccagatggagggggagggcgtgttcaagaacatccagcacctcacggtgaccgaggaggtcgccgtgcagaactggctggcccgggtggggcgcgagcgcctgtcccggatggcgatcagcggcgacgactgcgtcgtgaagcccctcgacgaccgcttcgccaacgccctgaccgccctgaacgacatgggcaagatccggaaggacatccagcagtgggagccgtccaaggggtggaacgactggacccaggtgcccttctgcagccaccacttccacgagctcatcatgaaggacggccgcgtcctggtggtgccctgccggaaccaggacgagctgatcgggcgcgcccggatctcccagggcgcggggtggagcctccgcgagacggcctgcctgggcaagtcctacgcccagatgtggagcctgatgtacttccaccggcgcgacctccggctggccgccaacgcgatctgctccgccgtccccagccactgggtgccgacctcccgcaccacctggagcatccacgccaagcacgagtggatgacgaccgaggacatgctgaccgtgtggaaccgggtctggatccgcgagaacccctggatggaggacaagacccccgtggagtcctgggaggagatcccctacctcggcaagcgggaggaccagtggtgcgggagcctgatcggcctgacctcccgcgccacgtgggccaagaacatccaggcggccatcaaccaggtgcggagcctcatcgggaacgaggagtacaccgactacatgccgagcatgaagcgcttccggcgcgaggaggaggaggccggcgtcctgtggtga

SEQ ID NO: 9542 - RNA, 9876 nt, synthetic construct
  misc_feature 1..9876: note = derived and/or modified CDS sequence (opt1) from DENV-2__FJ547064__SS-prME
  source 1..9876: mol_type = other RNA
agcgccgggatgatcatcatgctgatccccaccgtgatggccttccacctcaccacccggaacggggagccccacatggtcgtggggatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtcacctacgggacctgcaccaccaccggcgagcaccgccgggagaagcgcagcgtggccctggtgccccacgtcgggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtgctcatcttcatcctgctgacggccgtggccccctccatgaccatgcggtgcatcggcatcagcaaccgcgacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcggcctgttcggcaagggcgggatcgtgacgtgcgccatgttcacgtgcaagaagaacatggagggcaagatcgtgcagcccgagaacctggagtacaccatcgtcgtgacgccccactccggggaggagcacgcggtgggcaacgacacggggaagcacggccaggagatcaaggtcaccccgcagagctccatcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatgacggacgacatcgggatgggcgtgacctacctggccctgctcgccgcgttcaaggtccgccccaccttcgccgccggcctgctgctccggaagctgacctccaaggagctgatgatgacgaccatcgggatcgtgctcctgagccagtccaccatccccgagaccgtgctggagctcacggacgccctggccctgggcatgatggtcctcaagatcgtgcgcaacatggagaagtaccagctggcggtcaccatcatggccatcctgtgcgtgccgaacgccgtgatcctccagaacgcctggaaggtcagctgcaccatcctggccgtggtgtccgtcagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtgggcatggtgtccatcctggcgagctccctcctgaagaacgacatccccatgaccggccccctggtcgccgggggcctcctgaccgtgtgctacgtgctgacggggcgcagcgccgacctcgagctggagcgggccaccgacgtcaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtgatctccggcctgttcccgatcagcatccccatcaccgcggccgcctggtacctgtgggaggtgaagaagcagcgggccggggtcctctgggacgtgcccagcccgccgcccatgggcaaggccgagctggaggacggggcgtaccgcatcaagcagaagggcatcctggggtacagccagatcggcgccggcgtgtaccgggaggggaccttccacaccatgtggcacgtcacgcgcggcgccgtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgcggtgcagaccaagcccgggctgttcaagaccaacaccggcacgatcggggccgtctccctcgacttcagccccggcacctccggcagccccatcatcgacaagaaggggaaggtggtgggcctgtacgggaacggcgtcgtgacccggtccggcgcctacgtgagcgccatcgcccagaccgagaagtccatcgaggacaaccccgagatcgaggacgacatcttccgcaagcggcgcctgacgatcatggacctgcaccccggggcgggcaagaccaagcggtacctccccgccatcgtccgcgaggccatcaagcgggggctgcgcaccctgatcctcgccccgacccgggtggtggcggccgagatggaggaggccctgcgcggcctgcccatccggtaccagacgcccgccatccgcgccgagcacaccgggcgcgagatcgtcgacctcatgtgccacgcgaccttcaccatgcggctgctgagccccgtgcgcgtgccgaactacaacctcatcatcatggacgaggcccacttcacggaccccgcctccatcgccgcccggggctacatcagcacccgcgtcgagatgggcgaggcggccgggatcttcatgaccgccacgccgcccggcagccgggacccgttcccccagtccaacgcccccatcatcgacgaggagcgcgagatccccgagcggagctggaactccgggcacgagtgggtgacggacttcaagggcaagaccgtgtggttcgtcccgagcatcaaggccgggaacgacatcgtggcgtgcctgcgcaagaacggcaagaaggtgatccagctgtcccggaagaccttcgacagcgagtacgtcaagacccgcacgaacgactgggacttcgtggtgaccaccgacatctccgagatgggcgccaacttcaaggccgagcgggtcatcgacccccgccggtgcatgaagcccgtgatcctcaccgacggggaggagcgcgtgatcctggccggccccatgccggtcacgcacagctccgcggcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgccatcgacggcgagtaccgcctgcgcggggaggcgcggaagaccttcgtggacctcatgcgccggggcgacctgcccgtctggctggcctacaaggtggccgccgaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcgcgcatctactccgaccccctcgccctgaaggagttcaaggagttcgccgccggccggaagtccctgacgctcaacctgatcaccgagatgggccgcctgcccaccttcatgacccagaagacgcgggacgccctcgacaacctggcggtgctgcacaccgccgaggccgggggccgcgcctacaaccacgcgctctccgagctgcccgagaccctggagaccctcctgctgctcacgctgctggccaccgtcaccgggggcatcttcctcttcctgatgagcggccgggggatcggcaagatgaccctggggatgtgctgcatcatcaccgcctccatcctcctgtggtacgcccagatccagccgcactggatcgccgcgagcatcatcctggagttcttcctcatcgtgctgctgatccccgagcccgagaagcagcgcacgccccaggacaaccagctcacctacgtggtcatcgccatcctgaccgtggtggccgccaccatggccaacgagatgggcttcctggagaagacgaagaaggacctcgggctgggctccatcgcgacccagcagccggagagcaacatcctggacatcgacctccggcccgcctccgcctggaccctgtacgccgtcgccaccacgttcgtgacccccatgctgcgccacagcatcgagaacagctccgtgaacgtcagcctcaccgcgatcgccaaccaggccaccgtgctgatgggcctggggaagggctggcccctctccaagatggacatcggggtgccgctgctggccatcggctgctacagccaggtcaaccccatcacgctcaccgccgcgctgctgctcctggtggcccactacgccatcatcgggcccggcctgcaggccaaggcgacccgggaggcccagaagcgcgccgccgccggcatcatgaagaaccccaccgtggacgggatcacggtcatcgacctcgacccgatcccctacgaccccaagttcgagaagcagctgggccaggtgatgctgctcatcctgtgcgtgacccaggtcctgatgatgcggaccacctgggcgctctgcgaggccctgacgctggccaccgggcccatctccaccctctgggagggcaacccggggcgcttctggaacaccacgatcgccgtgagcatggccaacatcttccggggctcctacctggcgggcgccgggctcctcttcagcatcatgaagaacaccaccaacacccgccgcggcacggggaacatgggcgagaccctgggcgagaagtggaagtcccggctgaacgccctcggcaagagcgagttccagatctacaagaagtccggcatccaggaggtggaccgcaccctggccaaggaggggatcaagcggggcgagaccgaccaccacgccgtcagccgcgggtccgcgaagctgcggtggttcgtggagcgcaacatggtgacgcccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacctacgggtggaacctcgtgcggctgcagagcggcgtggacgtcttcttcatcccgcccgagaagtgcgacaccctgctctgcgacatcggggagtccagccccaacccgacggtggaggccggccgcaccctgcgggtgctgaacctcgtcgagaactggctgaacaacaacatccagttctgcatcaaggtgctgaacccctacatgccctccgtgatcgagaagatggaggccctgcagcgcaagtacggcggggccctcgtccggaacccgctgagccgcaacagcacccacgagatgtactgggtgtccaacgcgagcggcaacatcgtgtccagcgtcaacatgatctcccggatgctgatcaaccgcttcaccatgcggcacaagaaggccacctacgagcccgacgtggacctcgggagcggcacgcgcaacatcgggaccgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccgtgggacgtgctgcccatggtcacccagatggccatgacggacaccacccccttcgggcagcagcgcgtgttcaaggagaaggtggacacccggacgcaggagcccaaggagggcaccaagaagctgatgaagatcaccgcggagtggctctggaaggagctgggcaagaagaagaccccgcgcatgtgcacgcgggaggagttcacccgcaaggtccggtccaacgccgccctgggggccatcttcaccgacgagaacaagtggaagtccgcccgcgaggcggtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcccggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgcgatgtacgccgacgacacggccgggtgggacacccgcatcaccctcgaggacctgaagaacgaggagatggtgaccaaccacatggagggcgagcacaagaagctggccgaggcgatcttcaagctcacgtaccagaacaaggtggtccgggtgcagcgccccacgccccgggggaccgtgatggacatcatcagccgccgggaccagcgcggctccgggcaggtcggcacctacggcctgaacacgttcaccaacatggaggcccagctgatccggcagatggagggggagggcgtgttcaagaacatccagcacctcaccgtgaccgaggaggtcgccgtgaagaactggctggcccgcgtggggcgcgagcggctgagccgcatggccatctccggcgacgactgcgtcgtgaagcccctcgacgaccggttcgcgaacgccctgacggccctgaacgacatgggcaagatccgcaaggacatccagcagtgggagccgagcaaggggtggaacgactggacccaggtgcccttctgctcccaccacttccacgagctcatcatgaaggacggccgggtcctggtggtgccctgccgcaaccaggacgagctgatcgggcgggcccgcatcagccagggcgccgggtggtccctccgggagaccgcgtgcctgggcaagagctacgcccagatgtggtccctgatgtacttccaccgccgggacctccgcctggccgccaacgccatctgcagcgcggtcccctcccactgggtgccgaccagccggacgacctggtccatccacgccaagcacgagtggatgaccaccgaggacatgctgaccgtgtggaaccgcgtctggatccgggagaacccctggatggaggacaagacgcccgtggagagctgggaggagatcccctacctcggcaagcgcgaggaccagtggtgcgggtccctgatcggcctgaccagccgggccacctgggccaagaacatccaggccgcgatcaaccaggtgcgctccctcatcgggaacgaggagtacaccgactacatgccgagcatgaagcggttccgccgcgaggaggaggaggccggcgtcctgtggtga

SEQ ID NO: 9543 - RNA, 9876 nt, synthetic construct
  misc_feature 1..9876: note = derived and/or modified CDS sequence (opt1) from DENV-2__FJ410223__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggcgcacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagaagcggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcgccctgctggccaccgtgaccgggggcatcttcctcttcctgatgagcggccgcgggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcggacgccccaggacaaccagctcacctacgtcgtgatcgccatcctgacggtggtcgcggccaccatggccaacgagatgggcttcctggagaagaccaagaaggacctcgggctgggctccatcgccacccagcagccggagagcaacatcctggacatcgacctccgccccgcctccgcgtggacgctgtacgccgtggccaccaccttcgtgacccccatgctgcggcacagcatcgagaacagctccgtcaacgtgagcctcacggccatcgccaaccaggcgaccgtgctgatgggcctggggaagggctggcccctctccaagatggacatcggggtcccgctgctggccatcggctgctacagccaggtgaaccccatcaccctcaccgccgccctgctgctcctggtggcgcactacgccatcatcgggcccggcctgcaggccaaggccacgcgcgaggcccagaagcgggcggccgccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcacgacctgggccctctgcgaggccctgaccctggcgaccgggcccatctccacgctctgggagggcaacccggggcggttctggaacaccaccatcgccgtgagcatggccaacatcttccgcggctcctacctggccggcgccgggctcctcttcagcatcatgaagaacaccacgaacacccggcgcggcaccgggaacatgggcgagaccctgggcgagaagtggaagtcccgcctgaacgcgctcgggaagtccgagttccagatctacaagaagtccggcatccaggaggtcgaccggacgctggccaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggcccggccacgaggagcccatcccgatgtccacgtacgggtggaacctcgtgcgcctgcagagcggcgtcgacgtgttcttcatcccgcccgagaagtgcgacaccctgctctgcgacatcggggagtccagccccaacccgaccgtggaggcgggccggaccctgcgcgtcctgaacctcgtggagaactggctgaacaacaacacgcagttctgcatcaaggtgctgaacccctacatgccctccgtcatcgagaagatggaggccctgcagcggaagtacggcggggccctcgtgcgcaacccgctgagcggcaacctgaagaacgagatgtactgggtgagcaacgcctccgggaacatcgtcagctccgtgaacatgatcagccggatgctcatcaaccgcttcaccatgcggcacaagaaggccacctacgagcccgacgtggacctgggctccgggacccgcaacatcggcatcgagagcgagacccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtcaacggggtggtgcgcctcctgacgaagccgtgggacgtcctgcccaccgtgacccagatggccatgaccgacacgacccccttcggccagcagcgggtgttcaaggagaaggtcgacacccgcacccaggagcccaaggagggcacgaagaagctcatgaagatcaccgccgagtggctgtggaaggagctggggaagaagaagaccccgcgcatgtgcacccgggaggagttcacgcgcaaggtgcggagcaacgccgcgctcggcgccatcttcaccgacgagaacaagtggaagtccgcccgcgaggccgtggaggacagccggttctgggagctggtcgacaaggagcgcaacctgcacctcgaggggaagtgcgagacctgcgtgtacaacatgatgggcaagcgggagaagaagctgggggagttcggcaaggccaagggctcccgcgcgatctggtacatgtggctgggggcccggttcctcgagttcgaggccctgggcttcctgaacgaggaccactggttcagccgcgagaactccctcagcggggtcgagggcgaggggctgcacaagctgggctacatcctccgggacgtgtccaagaaggagggcggggccatgtacgcggacgacaccgccggctgggacacgcgcatcaccctggaggacctgaagaacgaggagatggtgaccaaccacatggagggggagcacaagaagctcgccgaggccatcttcaagctgacctaccagaacaaggtcgtgcgggtgcagcgccccacgccccggggcaccgtcatggacatcatcagccgccgggaccagcgcgggagcggccaggtgggcacctacgggctgaacaccttcacgaacatggaggcccagctcatccggcagatggagggcgagggggtgttcaagaacatccagcacctgaccgtcaccgaggaggtggcggtgcagaactggctggcccgcgtcggccgggagcgcctctcccgcatggccatcagcggcgacgactgcgtggtgaagcccctggacgaccggttcgccaacgccctgaccgcgctcaacgacatggggaagatccgcaaggacatccagcagtgggagccgtccaagggctggaacgactggacgcaggtccccttctgcagccaccacttccacgagctgatcatgaaggacgggcgggtgctggtggtcccctgccgcaaccaggacgagctcatcggccgggcccgcatctcccagggggccggctggagcctgcgggagaccgcctgcctgggcaagtcctacgcccagatgtggagcctcatgtacttccaccgccgggacctgcgcctggtggcgaacgccatctgctccgccgtgcccagccactgggtcccgacctcccggaccacgtggagcatccacgccaagcacgagtggatgaccaccgaggacatgctcaccgtgtggaaccgcgtgtggatccgggagaacccctggatggaggacaagacccccgtcgagtcctgggaggagatcccctacctggggaagcgcgaggaccagtggtgcggcagcctgatcgggctcacgtcccgggccacctgggcgaagaacatccaggccgccatcaaccaggtgcgcagcctgatcggcaacgaggagtacaccgactacatgccgtccatgaagcggttccgccgggaggaggaggaggccggggtgctgtggtga

SEQ ID NO: 9544 - RNA, 9876 nt, synthetic construct
  misc_feature 1..9876: note = derived and/or modified CDS sequence (opt1) from DENV-2__FJ410224__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccgtgacctacaagtgccccctcctgcggcagaacgagcccgaggacatcgactgctggtgcaacagcaccagcacctgggtcacctacgggacctgcaccaccaccggcgagcaccgccgggagaagcgcagcgtggccctggtgccccacgtcgggatgggcctcgagacccggaccgagacctggatgagcagcgagggggcctggaagcacgcccagcgcatcgagacctggatcctgcggcacccgggcttcacgatcatggccgcgatcctggcctacaccatcgggaccacccacttccagcgcgtgctcatcttcatcctgctgacggccgtggcccccagcatgaccatgcggtgcatcggcatcagcaaccgcgacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcggcctgttcggcaagggcgggatcgtgacgtgcgccatgttcacgtgcaagaagaacatggagggcaagatcgtgcagcccgagaacctggagtacaccatcgtcgtgacgccccactccggggaggagcacgcggtgggcaacgacacggggaagcacggcaaggagatcaaggtcaccccgcagagctccatcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggacggtgaccctgtacctgggcgtgatggtccaggccgacagcgggtgcgtggtgtcctggaagtccaaggagctcaagtgcggcagcggcatcttcatcaccgacaacgtccacacctggacggagcagtacaagttccagcccgagtcccccagcaagctggcctccgcgatccagaaggcccaggaggaggggatctgcggcatccgcagcgtgacccggctggagaacctcatgtggaagcagatcacccccgagctgaaccacatcctggccgagaacgaggtgaagctcaccatcatgacgggggacatcaagggcatcatgcaggccgggaagcgctccctgcggccgcagcccaccgagctgaagtacagctggaagacctggggcaaggccaagatgctctccaccgagagctacaaccagacgttcctgatcgacggccccgagaccgcggagtgcccgaacaccaaccgcgcctggaactccctggaggtcgaggactacgggttcggcgtgttcaccacgaacatctggctcaagctgaaggagaagcaggacgccttctgcgacagcaagctgatgtccgccgccatcaaggacaaccgggcggtgcacgccgacatggggtactggatcgagagcgccctcaacgacacctggaagatcgagaaggcctccttcatcgaggtcaagaactgccactggcccaagagccacaccctgtggtccaacggcgtgctggagagcgagatgatcatccccaagaacctcgccggccccgtgtcccagcacaactaccgcccggggtaccacacccagatcgcgggcccctggcacctggggaagctggagatggacttcgacttctgcgacggcaccacggtcatcgtgaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtcaccgccggccacggccaggtggacaacttctccctgggcgtgctgggcatggccctcttcctggaggagatgctgcggacgcgcgtcgggaccaagcacgcgatcctcctggtggccgtgagcttcgtcaccctgatcaccggcaacatgtccttcaaggacctcgggcgggtggtggtcatggtgggcgccacgatggccgacgacatcgggatgggcgtgacctacctggccctgctcgcggccttcaaggtccgccccaccttcgccgccggcctgctgctccggaagctgaccagcaaggagctgatgatgacgaccatcgggatcgtgctcctgtcccagagcaccatccccgagaccgtgctggagctcacggacgccctggcgctgggcatgatggtcctcaagatcgtgcgcaacatggagaagtaccagctggccgtcaccatcatggccatcctgtgcgtgccgaacgccgtgatcctccagaacgcctggaaggtctcctgcaccatcctggcggtggtgagcgtcagccccctgctcctgaccagctcccagcagaagacggactggatccccctggccctcaccatcaaggggctgaaccccaccgccatcttcctgaccacgctcagccgcaccaacaagaagcggtcctggccgctgaacgaggccatcatggcggtgggcatggtgagcatcctggcctccagcctcctgaagaacgacatccccatgaccggccccctggtcgccgggggcctcctgaccgtgtgctacgtgctgacggggcgctccgccgacctcgagctggagcgggccaccgacgtcaagtgggaggaccaggcggagatcagcggcagctcccccatcctgagcatcaccatctccgaggacgggagcatgtccatcaagaacgaggaggaggagcagaccctcacgatcctgatccgcaccggcctgctcgtgatcagcggcctgttcccgatctccatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtactcccagatcggcgccggcgtgtacaaggaggggaccttccacaccatgtggcacgtcacgcggggcgccgtgctcatgcacaaggggaagcgcatcgagcccagctgggccgacgtgaagaaggacctgatctcctacggcgggggctggaagctggagggcgagtggaaggagggggaggaggtccaggtgctcgcgctggagcccggcaagaacccccgggccgtgcagaccaagcccgggctgttcaagaccaacaccggcacgatcggggccgtcagcctcgacttctcccccggcaccagcggctcccccatcatcgacaagaaggggaaggtggtgggcctgtacgggaacggcgtcgtgacccgcagcggcgcctacgtgtccgccatcgcgcagaccgagaagtccatcgaggacaaccccgagatcgaggacgacatcttccggaagcgccggctgacgatcatggacctgcaccccggggccggcaagaccaagcgctacctccccgccatcgtccgggaggccatcaagcgcgggctgcggaccctgatcctcgcgccgacccgcgtggtggccgccgagatggaggaggccctgcggggcctgcccatccgctaccagacgcccgccatccgggcggagcacaccgggcgcgagatcgtcgacctcatgtgccacgccaccttcaccatgcgcctgctgtcccccgtgcgggtgccgaactacaacctcatcatcatggacgaggcccacttcacggaccccgccagcatcgccgcgcgcggctacatcagcacccgggtcgagatgggcgaggccgccgggatcttcatgaccgccacgccgcccggctcccgcgacccgttcccccagagcaacgcccccatcatcgacgaggagcgggagatccccgagcgctcctggaacagcgggcacgagtgggtgacggacttcaagggcaagaccgtgtggttcgtcccgtccatcaaggcggggaacgacatcgccgcctgcctgcggaagaacggcaagaaggtgatccagctgagccgcaagaccttcgactccgagtacgtgaagacccggacgaacgactgggacttcgtcgtgaccaccgacatcagcgagatgggcgccaacttcaaggcggagcgcgtgatcgacccccggcgctgcatgaagcccgtcatcctcaccgacggggaggagcgggtgatcctggccggccccatgccggtgacgcactccagcgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgccgcgggccgcaagtccctgacgctcaacctgatcaccgagatgggccggctgcccaccttcatgacccagaagacgcgcgacgccctcgacaacctggccgtgctgcacaccgccgaggccggcgggcgggcctacaaccacgccctcagcgagctgcccgagaccctggagaccctcctgctgctcacgctgctggccaccgtgaccgggggcatcttcctcttcctgatgtccggccgcgggatcggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtgatcgccatcctgaccgtcgtggccgcgaccatggccaacgagatgggcttcctggagaagacgaagaaggacctcgggctgggcagcatcgccacccagcagccggagtccaacatcctggacatcgacctccgccccgccagcgcctggaccctgtacgcggtggccaccacgttcgtcacccccatgctgcggcacagcatcgagaactccagcgtgaacgtgtccctcaccgccatcgccaaccaggccaccgtcctgatgggcctggggaagggctggcccctcagcaagatggacatcggggtgccgctgctggcgatcggctgctactcccaggtgaaccccatcacgctcaccgccgccctgctgctcctggtcgcccactacgcgatcatcgggcccggcctgcaggccaaggccacccgcgaggcccagaagcgggccgcggccggcatcatgaagaaccccaccgtggacgggatcacggtgatcgacctcgacccgatcccctacgaccccaagttcgagaagcagctgggccaggtcatgctgctcatcctgtgcgtgacccaggtgctgatgatgcgcaccacctgggccctctgcgaggccctgacgctggccaccgggcccatcagcaccctctgggagggcaacccggggcggttctggaacaccacgatcgcggtctccatggccaacatcttccgcggcagctacctggccggcgccgggctcctcttctccatcatgaagaacaccaccaacacccggcgcggcacggggaacatcggcgagaccctgggcgagaagtggaagtcccgcctgaacgccctcgggaagtccgagttccagacctacaagaagtccggcatccaggaggtggaccggaccctggcgaaggaggggatcaagcgcggcgagacggaccaccacgccgtgtcccgggggagcgccaagctgcgctggttcgtcgagcggaacatggtgacccccgagggcaaggtggtcgacctcggctgcgggcgcggcgggtggtcctactactgcggcgggctgaagaacgtgcgggaggtgaagggcctgaccaagggcgggcccggccacgaggagcccatcccgatgagcacctacgggtggaacctcgtccgcctgcagtccggcgtggacgtgttcttcatcccgcccgagaagtgcgacacgctgctctgcgacatcggggagagctcccccaacccgaccgtcgaggccggccggaccctgcgcgtgctgaacctcgtggagaactggctgaacaacaacacccagttctgcatcaaggtcctgaacccctacatgcccagcgtgatcgagaagatggaggcgctgcagcggaagtacggcggggccctcgtgcgcaacccgctgagccggaactccacccacgagatgtactgggtcagcaacgcctccggcaacatcgtgagctccgtgaacatgatcagccgcatgctgatcaaccggttcacgatgcgccacaagaaggccacctacgagcccgacgtcgacctcgggtccggcacccggaacatcgggatcgagagcgagatccccaacctggacatcatcggcaagcgcatcgagaagatcaagcaggagcacgagacctcctggcactacgaccaggaccacccctacaagacgtgggcctaccacggcagctacgagaccaagcagaccgggtccgcgagctccatggtgaacggcgtggtccggctgctcaccaagccgtgggacgtgctgcccacggtgacccagatggccatgaccgacaccacgcccttcgggcagcagcgcgtcttcaaggagaaggtggacacccgcacccaggagcccaaggagggcaccaagaagctgatgaagatcacggccgagtggctctggaaggagctgggcaagaagaagaccccgcggatgtgcacccgcgaggagttcacccggaaggtgcgcagcaacgccgccctgggggcgatcttcacggacgagaacaagtggaagtccgcccgggaggccgtcgaggacagccgcttctgggagctcgtggacaaggagcggaacctgcacctggagggcaagtgcgagacctgcgtctacaacatgatggggaagcgcgagaagaagctcggcgagttcgggaaggccaagggctcccgggccatctggtacatgtggctgggcgcgcgcttcctggagttcgaggccctcgggttcctgaacgaggaccactggttcagccgggagaactccctgagcggcgtggagggggagggcctccacaagctggggtacatcctgcgcgacgtgagcaagaaggagggcggcgccatgtacgccgacgacaccgcggggtgggacacccggatcacgctcgaggacctgaagaacgaggagatggtcaccaaccacatggagggcgagcacaagaagctggccgaggccatcttcaagctcacctaccagaacaaggtggtgcgcgtccagcggcccacgccccgggggacggtgatggacatcatctcccggcgcgaccagcggggcagcggccaggtggggacctacggcctgaacaccttcaccaacatggaggcccagctgatccgccagatggagggggagggcgtcttcaagaacatccagcacctcacggtgaccgaggaggtggccgtccagaactggctggcgcgggtggggcgcgagcgcctgtcccggatggccatcagcggcgacgactgcgtggtcaagcccctcgacgaccgcttcgccaacgccctgaccgccctgaacgacatgggcaagatccggaaggacatccagcagtgggagccgtccaaggggtggaacgactggacccaggtgcccttctgcagccaccacttccacgagctcatcatgaaggacggccgcgtgctggtcgtgccctgccggaaccaggacgagctgatcgggcgcgcgcggatctcccagggcgccgggtggagcctccgcgagacggcctgcctgggcaagtcctacgcccagatgtggagcctgatgtacttccaccggcgcgacctccggctggccgcgaacgccatctgctccgccgtgcccagccactgggtcccgacctcccgcaccacctggagcatccacgccaagcacgagtggatgaccacggaggacatgctgaccgtgtggaaccgggtgtggatccgcgagaacccctggatggaggacaagacccccgtcgagtcctgggaggagatcccctacctcggcaagcgggaggaccagtggtgcgggagcctgatcggcctgacctcccgcgccacgtgggcgaagaacatccaggccgccatcaaccaggtgcggagcctcatcgggaacgaggagtacaccgactacatgccgagcatgaagcgcttccggcgcgaggaggaggaggccggcgtgctgtggtga

SEQ ID NO: 9545 - RNA, 9876 nt, synthetic construct
  misc_feature 1..9876: note = derived and/or modified CDS sequence (opt1) from DENV-2__FJ461321__SS-prME
  source 1..9876: mol_type = other RNA
agcgccgggatgatcatcatgctgatccccaccgtgatggccttccacctcaccacccggaacggggagccccacatgatcgtcgggatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacagcgtgggcaacgacacggggaagcacggcatggagatcaaggtgaccccgcagtccagcatcaccgaggcggagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagagcaactggatccagaaggagaccctggtcaccttcaagaacccccacgccaagaagcaggacgtggtcgtgctcggcagccaggagggggccatgcacacggcgctgaccggcgccaccgagatccagatgtccagcgggaacctcctgttcaccggccacctgaagtgccggctgcgcatggacaagctccagctgaagggcatgtcctacagcatgtgcacggggaagttcaaggtggtcaaggagatcgccgagacccagcacggcaccatcgtgatccgggtgcagtacgagggggacggctccccctgcaagatccccttcgagatcatggacctggagaagcgctacgtcctcggccggctgatcaccgtgaacccgatcgtgacggagaaggacagccccgtcaacatcgaggccgagccgcccttcggggactcctacatcatcatcggcgtggagccggggcagctgaagctcaactggttcaagaagggcagctccatcgggcagatgttcgagaccaccatgcgcggcgccaagcgcatggcgatcctgggcgacaccgcctgggacttcgggagcctgggcggggtgttcacgtccatcggcaaggccctccaccaggtcttcggggccatctacggcgccgcgttcagcggcgtgtcctggaccatgaagatcctgatcggggtgatcatcacctggatcggcatgaacagccggtccaccagcctgtccgtcagcctggtgctcgtggggatcgtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcgcaggaggaggggatctgcggcatccgcagcgtcacgcggctggagaacctcatgtggaagcagatcacccccgagctgaaccacatcctggccgagaacgaggtgaagctcaccatcatgaccggggacatccgcggcatcatgcaggccgggaagcggtccctgcgcccgcagcccacggagctgaagtacagctggaagacctggggcaaggccaagatgctctccaccgagagctacaaccagaccttcctgatcgacggccccgagacggccgagtgcccgaacaccaaccgggcgtggaactccctggaggtggaggactacgggttcggcgtcttcaccaccaacatctggctcaagctgaaggagaagcaggacgccttctgcgacagcaagctgatgtccgccgccatcaaggacaaccgcgccgtgcacgcggacatggggtactggatcgagagcgccctcaacgacacgtggaagatcgagaaggcctccttcatcgaggtgaagaactgccactggcccaagagccacaccctgtggtccaacggcgtcctggagagcgagatgatcatccccaagaacctcgccggccccgtgtcccagcacaactaccggccggggtaccacacccagatcgccggcccctggcacctggggaagctggagatggacttcgacttctgcgacggcaccaccgtgatcgtcacggaggactgcgggaaccgcggccccagcctccggaccaccaccgcgagcggcaagctgatcacggagtggtgctgccgctcctgcaccctgcccccgctccggtaccgcggggaggacggctgctggtacgggatggagatccggcccctgaaggagaaggaggagaacctggtgaacagcctcgtgaccgccggccacgggcaggtcgacaacttctccctgggcgtgctgggcatggccctcttcctggaggagatgctgcgcacccgggtggggacgaagcacgccatcctcctggtcgcggtgagcttcgtgaccctgatcaccggcaacatgtccttcaaggacctcgggcgcgtcgtggtgatggtcggcgccaccatggccgacgacatcgggatgggcgtgacgtacctggccctgctcgccgcgttcaaggtgcggcccaccttcgccgccggcctgctgctccgcaagctgaccagcaaggagctgatgatgaccacgatcgggatcgtcctcctgtcccagagcaccatccccgagaccgtgctggagctcaccgacgccctggccctgggcatgatggtgctcaagatcgtccgcaacatggagaagtaccagctggcggtgacgatcatggccatcctgtgcgtcccgaacgccgtgatcctccagaacgcctggaaggtgtcctgcaccatcctggccgtcgtgagcgtgagccccctgctcctgaccagctcccagcagaagaccgactggatccccctggcgctcacgatcaaggggctgaaccccaccgccatcttcctgaccaccctcagccggacgaacaagaagcgctcctggccgctgaacgaggccatcatggccgtcggcatggtgagcatcctggcgtccagcctcctgaagaacgacatccccatgaccggccccctggtggccgggggcctcctgaccgtctgctacgtgctgaccgggcggtccgccgacctcgagctggagcgcgccacgaacgtgaagtgggaggaccaggccgagatcagcggcagctcccccatcctgagcatcaccatctccgaggacgggagcatgtccatcaagaacgaggaggaggagcagaccctcaccatcctgatccggacgggcctgctcgtcatcagcggcctgttcccgatctccatccccatcaccgcggccgcctggtacctgtgggaggtgaagaagcagcgcgccggggtgctctgggacgtcccctccccgccgcccatgggcaaggccgagctggaggacggggcgtaccggatcaagcagaagggcatcctggggtactcccagatcggcgccggcgtgtacaaggaggggaccttccacaccatgtggcacgtgacccgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccccgcgcggtgcagacgaagcccgggctgttcaagaccaacaccggcaccatcggggccgtgagcctcgacttctcccccggcacgagcggctcccccatcatcgacaagaaggggaaggtcgtgggcctgtacgggaacggcgtggtcacccggagcggcgcctacgtgtccgccatcgcccagaccgagaagtccatcgaggacaaccccgagatcgaggacgacatcttccgcaagcggcgcctgaccatcatggacctgcaccccggggcgggcaagacgaagcggtacctccccgccatcgtgcgcgaggccatcaagcgggggctgcgcaccctgatcctcgccccgacccgggtcgtggcggccgagatggaggaggccctgcgcggcctgcccatccggtaccagacccccgccatccgcgccgagcacacggggcgcgagatcgtggacctcatgtgccacgcgaccttcaccatgcggctgctgtcccccgtccgcgtgccgaactacaacctcatcatcatggacgaggcccacttcaccgaccccgccagcatcgccgcccggggctacatcagcacgcgcgtggagatgggcgaggcggccgggatcttcatgaccgccacgccgcccggctcccgggacccgttcccccagagcaacgcccccatcatcgacgaggagcgcgagatccccgagcggtcctggaacagcgggcacgagtgggtcaccgacttcaagggcaagacggtgtggttcgtgccgtccatcaaggccgggaacgacatcgcggcctgcctgcgcaagaacggcaagaaggtcatccagctgagccggaagaccttcgactccgagtacgtgaagacccgcaccaacgactgggacttcgtggtcacgaccgacatcagcgagatgggcgccaacttcaaggccgagcgggtgatcgacccccgccggtgcatgaagcccgtgatcctcaccgacggggaggagcgcgtcatcctggcgggccccatgccggtgacccactccagcgccgcccagcggcgcgggcggatcggccgcaaccccaagaacgagaacgaccagtacatctacatgggggagcccctggagtccgacgaggactgcgcccactggaaggaggccaagatgctcctggacaacatcaacacgcccgagggcatcatcccgagcatgttcgagcccgagcgggagaaggtggacgcgatcgacggcgagtaccgcctgcgcggggaggcccggaagaccttcgtcgacctcatgcgccggggcgacctgcccgtgtggctggcctacaaggtggccgccgaggggatcaactacgcggaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgccggccgcaagagcctgaccctcaacctgatcacggagatgggccgcctgcccaccttcatgacccagaagacccgggacgcgctcgacaacctggccgtcctgcacacggccgaggccgggggccgcgcgtacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacgtacgtcgtgatcgccatcctgaccgtggtcgccgccaccatggcgaacgagatgggcttcctggagaagaccaagaaggacctcgggctgggctccatcgccacgcagcagccggagagcaacatcctggacatcgacctccggcccgccagcgcctggaccctgtacgccgtggcgaccaccttcgtgacgcccatgctgcgccactccatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcaccctcacggcggccctgctgctcctggtggcccactacgccatcatcgggcccggcctgcaggcgaaggccacccgggaggcccagaagcgcgccgccgcgggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgccgtgagcatggcgaacatcttccggggctcctacctggccggcgccgggctcctcttcagcatcatgaagaacacgaccaacacccgccgcggcaccgggaacatcggcgagacgctgggcgagaagtggaagtcccggctgaacgccctcggcaagagcgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgcccagcgtcatcgagaagatggaggccctgcagcgcaagtacggcggggcgctcgtgcggaacccgctgtcccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctcaccaagccgtgggacgtcctgcccaccgtgacccagatggcgatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggccatcttcaccgacgagaacaagtggaagtccgcgcgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgagcggcgtcgagggggagggcctccacaagctggggtacatcctgcgggacgtgtccaagaaggagggcggcgccatgtacgccgacgacacggccgggtgggacacccgcatcaccctcgaggacctgaagaacgaggagatggtgaccaaccacatggagggcgagcacaagaagctggcggaggccatcttcaagctcacgtaccagaacaaggtcgtgcgggtgcagcgccccacgccccgggggaccgtcatggacatcatcagccgccgggaccagcgcggctccggccaggtgggcacctacggcctgaacacgttcaccaacatggaggcccagctgatccggcagatggagggggagggcgtgttcaagaacatccagcacctcaccgtcaccgaggaggtggccgtgcacaactggctggcccgcgtcgggcgcgagcggctgagccgcatggcgatctccggcgacgactgcgtggtgaagcccctcgacgaccggttcgccaacgccctgacggccctgaacgacatgggcaagatccgcaaggacatccagcagtgggagccgagcaaggggtggaacgactggacccaggtccccttctgctcccaccacttccacgagctcatcatgaaggacggccggatcctggtggtgccctgccgcaaccaggacgagctgatcgggcgggcccgcatcagccagggcgcggggtggtccctccgggagaccgcctgcctgggcaagagctacgcccagatgtggtccctgatgtacttccaccgccgggacctccgcctggccgccaacgcgatctgcagcgccgtcccctcccactgggtgccgaccagccggacgacctggtccatccacgccaagcacgagtggatgaccaccgaggacatgctgaccgtgtggaaccgcgtctggatccgggagaacccctggatggaggacaagacgcccgtggagagctgggaggagatcccctacctcggcaagcgcgaggaccagtggtgcgggtccctgatcggcctgaccagccgggccacctgggccaagaacatccaggcggccatcaaccaggtgcgcagcctcatcgggaacgaggagtacaccgactacatgccgtccatgaagcggttccgccgcgaggaggaggaggccggcgtcctgtggtga

SEQ ID NO: 9546 - RNA, 9876 nt, synthetic construct
  misc_feature 1..9876: note = derived and/or modified CDS sequence (opt1) from DENV-2__FJ410228__SS-prME
  source 1..9876: mol_type = other RNA
agcgcggggatgatcatcatgctgatccccaccgtgatggccttccacctcaccacccgcaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaacggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccgcggcaccgggaacatcggcgagacgctgggcgagaagtggaagtcccggctgaacgccctcggcaagagcgagttccagatctacaagaagtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacacggcggggtgggacacccgcatcaccctcgaggacctgaagaacgaggagatggtgaccaaccacatggagggcgagcacaagaagctggccgaggccatcttcaagctcacgtaccagaacaaggtcgtgcgggtgcagcgccccacgccccgggggaccgtcatggacatcatcagccgccgggaccagcgcggctccggccaggtgggcacctacggcctgaacacgttcaccaacatggaggcccagctgatccggcagatggagggggagggcgtgttcaagaacatccagcacctcaccgtcaccgaggaggtggccgtgcacaactggctggcgcgcgtcgggcgcgagcggctgagccgcatggccatctccggcgacgactgcgtggtgaagcccctcgacgaccggttcgccaacgccctgacggccctgaacgacatgggcaagatccgcaaggacatccagcagtgggagccgagcaaggggtggaacgactggacccaggtccccttctgctcccaccacttccacgagctcatcatgaaggacggccggatcctggtggtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtcccctcccactgggtgccgaccagccggacgacctggtccatccacgccaagcacgagtggatgaccaccgaggacatgctgaccgtgtggaaccgcgtctggatccgggagaacccctggatggaggacaagacgcccgtggagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacaccgactacatgccgagcatgaagcggttccgccgcgaggaggaggaggccggcgtcctgtggtga

SEQ ID NO: 9547 - RNA, 9876 nt, synthetic construct
  misc_feature 1..9876: note = derived and/or modified CDS sequence (opt1) from DENV-2__FJ410233__SS-prME
  source 1..9876: mol_type = other RNA
agcgccgggatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcaacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatgacggacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacatggaggtcgagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtgctgcacaccgccgaggccgggggccgggcgtacaaccacgccctctccgagctgcccgagaccctggagaccctcctgctgctcacgctgctggccaccgtcaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtggtcatcgccatcctgaccgtggtggccgccaccatggcgaacgagatgggcttcctggagaagacgaagaaggacctcgggctgggctccatcgccacccgccagccggagagcaacatcctggacatcgacctccggcccgcctccgcctggaccctgtacgccgtcgcgaccacgttcgtgacccccatgctgcgccacagcatcgagaacagctccgtgaacgtcagcctcaccgccatcgccaaccaggccaccgtgctgatgggcctggggaagggctggcccctctccaagatggacatcggggtgccgctgctggccatcggctgctacagccaggtcaaccccatcacgctcaccgcggccctgctgctcctggtggcccactacgccatcatcgggcccggcctgcaggcgaaggccacccgggaggcccagaagcgcgccgccgcgggcatcatgaagaaccccaccgtggacgggatcacggtcatcgacctcgacccgatcccctacgaccccaagttcgagaagcagctgggccaggtgatgctgctcgtgctgtgcgtcacccaggtgctgatgatgcggaccacctgggccctctgcgaggccctgacgctggccaccgggcccatctccaccctctgggagggcaacccggggcgcttctggaacaccacgatcgccgtgagcatggcgaacatcttccggggctcctacctggccggcgccgggctcctcttcagcatcatgaagaacaccaccaacacccgccgcggcacggggaacatgggcgagaccctgggcgagaagtggaagtcccggctgaacgccctcgggaagtccgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacgcccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgacggtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctgctcaccaagccgtgggacgtcctgcccaccgtgacgcagatggcgatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggccatcttcaccgacgagaacaagtggaagtccgcgcgcgaggccgtggaggactcccggttctgggagctcgtcgacaaggagcgcaacctgcacctggagggcaagtgcgagacgtgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgccgggtgggacacccgcatcaccctcgaggacctgaagaacgaggagatggtgacgaaccacatggagggcgagcacaagaagctggcggaggccatcttcaagctcacctaccagaacaaggtcgtgcgggtgcagcgccccacgccccgggggaccgtcatggacatcatcagccgccgggaccagcgcggctccggccaggtggggacgtacggcctgaacaccttcaccaacatggaggcccagctgatccggcagatggagggggagggcgtgttcaagaacatccagcacctcaccgtcacggaggaggtggccgtgaagaactggctggcccgcgtcgggcgcgagcggctgagccgcatggcgatctccggcgacgactgcgtggtgaagcccctcgacgaccggttcgccaacgccctgaccgccctgaacgacatgggcaagatccgcaaggacatccagcagtgggagccgagcaaggggtggaacgactggacccaggtccccttctgctcccaccacttccacgagctcatcatgaaggacggccgggtgctggtggtcccctgccgcaaccaggacgagctgatcgggcgggcccgcatcagccagggcgcggggtggtccctccgggagaccgcctgcctgggcaagagctacgcccagatgtggtccctgatgtacttccaccgccgggacctccgcctggccgccaacgcgatctgcagcgccgtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctcggcaagcgcgaggaccagtggtgcgggtccctgatcggcctgaccagccgggccacctgggccaagaacatccaggcggccatcaaccaggtccgctccctcatcgggaacgaggagtacacggactacatgccgagcatgaagcggttccgccgcgaggaggaggaggccggcgtgctgtggtga

SEQ ID NO: 9548 - RNA, 9876 nt, synthetic construct
  misc_feature 1..9876: note = derived and/or modified CDS sequence (opt1) from DENV-2__FJ410237__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatgacggacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtcctgcacaccgccgaggccgggggccgggcgtacaaccacgccctctccgagctgcccgagaccctggagaccctcctgctgctcacgctgctggccaccgtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccaccatggcgaacgagatgggcttcctggagaagacgaagaaggacctcgggctgggctccatcgccacccagcagccggagagcaacatcctggacatcgacctccgccccgcctccgcctggaccctgtacgccgtggcgaccacgttcgtgacccccatgctgcggcacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcacgctcaccgcggccctgctgctcctggtggcccactacgccatcatcgggcccggcctgcaggcgaaggccacccgcgaggcccagaagcgggccgccgcgggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcaacccggggcggttctggaacaccacgatcgccgtgagcatggcgaacatcttccgcggctcctacctggccggcgccgggctcctcttcagcatcatgaagaacaccaccaacacccggcgcggcacggggaacatgggcgagaccctgggcgagaagtggaagtcccgcctgaacgccctcgggaagtccgagttccagatctacaagaagtccggcatccaggaggtcgaccggaccctggccaaggaggggatcaagcgcggcgagaccgaccaccacgcggtgagccgggggtccgccaagctgcgctggttcgtggagcggaacatggtcacgcccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgacggtggaggccggccggaccctgcgcgtcctgaacctcgtggagaactggctgaacaacaacacccagttctgcatcaaggtgctgaacccctacatgccctccgtcatcgagaagatggaggccctgcagcggaagtacggcggggcgctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacgtacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtcaacggcgtggtgcggctgctcaccaagccgtgggacgtcctgcccaccgtgacgcagatggcgatgaccgacaccacccccttcgggcagcagcgcgtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtcgtgcgcgtgcagcggcccacgccccgggggaccgtcatggacatcatcagccggcgcgaccagcggggctccggccaggtggggacgtacggcctgaacaccttcaccaacatggaggcccagctgatccgccagatggagggggagggcgtgttcaagaacatccagcacctcaccgtcacggaggaggtggccgtgaagaactggctggcccgggtcgggcgcgagcgcctgagccggatggcgatctccggcgacgactgcgtggtgaagcccctcgacgaccgcttcgccaacgccctgaccgccctgaacgacatgggcaagatccggaaggacatccagcagtgggagccgagcaaggggtggatcgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggccaagaacatccaggcggccatcaaccaggtccggtccctcatcgggaacgaggagtacgccgactacatgccgagcatgaagcgcttccggcgcgaggaggaggaggccggcgtgctgtggtga

SEQ ID NO: 9549 - RNA, 9876 nt, synthetic construct
  misc_feature 1..9876: note = derived and/or modified CDS sequence (opt1) from DENV-2__FJ410241__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgaagacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctccggatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagctggagagcaacatcctcgacatcgacctgcgcccggcctccgcctggaccctgtacgcggtggccaccaccttcgtgacgcccatgctccggcacagcatcgagaacagctccgtcaacgtgagcctgaccgccatcgccaaccaggccaccgtgctgatgggcctcgggaagggctggcccctgtccaagatggacatcggggtccccctgctcgcgatcggctgctacagccaggtgaacccgatcaccctgacggccgccctgctcctgctggtggcccactacgcgatcatcgggcccggcctccaggccaaggccacccgcgaggcccagaagcgggccgcggccggcatcatgaagaaccccaccgtcgacgggatcaccgtgatcgacctggaccccatcccgtacgaccccaagttcgagaagcagctgggccaggtgatgctcctgatcctgtgcgtcacccaggtgctcatgatgcgcaccacctgggccctgtgcgaggccctgaccctcgccacggggcccatctccaccctgtgggagggcaaccccgggcggttctggaacaccaccatcgcggtgagcatggccaacatcttccgcggctcctacctggccggcgccgggctcctgttcagcatcatgaagaacacgaccaacacccggcgcggcaccgggaacatgggcgagacgctgggcgagaagtggaagtcccgcctcaacgccctggggaagtccgagttccagatctacaagaagtccggcatccaggaggtcgaccggaccctggcgaaggaggggatcaagcgcggcgagaccgaccaccacgccgtgagccgggggtccgccaagctccgctggttcgtggagcggaacatggtcaccccggagggcaaggtggtggacctgggctgcgggcgcggcgggtggagctactactgcggcgggctgaagaacgtccgggaggtgaagggcctcacgaagggcgggcccggccacgaggagcccatccccatgtccacctacgggtggaacctggtgcgcctgcagagcggcgtcgacgtgttcttcatcccgcccgagaagtgcgacaccctcctgtgcgacatcggggagtccagccccaaccccaccgtggaggccggccggacgctgcgcgtcctcaacctggtggagaactggctgaacaacaacacccagttctgcatcaaggtgctgaacccgtacatgccctccgtcatcgagaagatggaggcgctccagcggaagtacggcggggccctggtgcgcaaccccctgagccggaacagcacccacgagatgtactgggtgtccaacgccagcggcaacatcgtctccagcgtgaacatgatctcccgcatgctcatcaaccggttcaccatgcgccacaagaaggccacctacgagccggacgtggacctggggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcggctcctgaccaagccctgggacgtcctgccgaccgtgacccagatggccatgacggacaccacccccttcgggcagcagcgcgtgttcaaggagaaggtcgacacccgcacgcaggagcccaaggagggcaccaagaagctcatgaagatcaccgccgagtggctgtggaaggagctgggcaagaagaagacgccccggatgtgcacgcgcgaggagttcacccggaaggtgcgctccaacgccgccctcggggcgatcttcaccgacgagaacaagtggaagtccgcccgggaggccgtggaggactcccgcttctgggagctggtcgacaaggagcggaacctgcacctcgagggcaagtgcgagacctgcgtgtacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttctcccgggagaacagcctctccggcgtcgagggggagggcctgcacaagctggggtacatcctccgcgacgtgagcaagaaggagggcggcgccatgtacgccgacgacacggcggggtgggacacccggatcaccctggaggacctgaagaacgaggagatggtgaccaaccacatggagggcgagcacaagaagctcgccgaggccatcttcaagctgacgtaccagaacaaggtcgtgcgcgtgcagcggccgacgccccgggggaccgtcatggacatcatcagccggcgcgaccagcggggctccggccaggtggggacctacggcctgaacacgttcaccaacatggaggcccagctcatccgccagatggagggggagggcgtgttcaagaacatccagcacctgaccgtcaccgaggaggtggccgtgcagaactggctggcgcgggtcgggcgcgagcgcctcagccggatggccatctccggcgacgactgcgtggtgaagcccctggacgaccgcttcgccaacgccctgacggccctcaacgacatgggcaagatccggaaggacatccagcagtgggagcccagcaaggggtggaacgactggacccaggtcccgttctgctcccaccacttccacgagctgatcatgaaggacggccgcgtgctggtggtcccctgccggaaccaggacgagctcatcgggcgcgcgcggatcagccagggcgccgggtggtccctgcgcgagaccgcctgcctgggcaagagctacgcccagatgtggtccctcatgtacttccaccggcgcgacctgcggctggccgcgaacgccatctgcagcgccgtgccctcccactgggtgcccaccagccgcacgacctggtccatccacgccaagcacgagtggatgaccaccgaggacatgctcaccgtctggaaccgggtgtggatccgcgagaacccgtggatggaggacaagacgcccgtggagagctgggaggagatcccctacctgggcaagcgggaggaccagtggtgcgggtccctgatcggcctcaccagccgcgccacctgggcgaagaacatccaggccgccatcaaccaggtccggtccctgatcgggaacgaggagtacaccgactacatgcccagcatgaagcgcttccggcgcgaggaggaggaggccggcgtgctgtggtga

SEQ ID NO: 9550 - RNA, 9876 nt, synthetic construct
  misc_feature 1..9876: note = derived and/or modified CDS sequence (opt1) from DENV-2__FJ410259__SS-prME
  source 1..9876: mol_type = other RNA
agcgccgggatgatcatcatgctgatccccaccgtgatggccttccacctcaccacccgcaacggggagccccacatgatcgtggggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccaccaccgaggccgagctgaccgggtacggcacggtcaccatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcacgttcaagaacccccacgccaagaagcaggacgtggtcgtgctcggcagccaggagggggcgatgcacaccgccctgaccggcgccaccgagatccagatgagctccgggaacctcctgttcacgggccacctgaagtgccggctgcgcatggacaagctccagctgaagggcatgagctactccatgtgcaccgggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcacggtgaacccgatcgtgaccgagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacacggcctgggacttcgggtccctgggcggggtgttcaccagcatcggcaaggccctccaccaggtcttcggggccatctacggcgcggccttctccggcgtgagctggaccatgaagatcctgatcggggtgatcatcacctggatcggcatgaactcccggagcacgtccctgagcgtctccctggtgctcgtggggatcgtcaccctgtacctgggcgtgatggtgcaggccgacagcgggtgcgtcgtgtcctggaagaacaaggagctcaagtgcggcagcggcatcttcatcaccgacaacgtgcacacctggacggagcagtacaagttccagcccgagagcccctccaagctggccagcgcgatccagaaggcccaggaggaggggatctgcggcatccgctccgtcacccggctggagaacctcatgtggaagcagatcacccccgagctgaaccacatcctggccgagaacgaggtgaagctcaccatcatgacgggggacatccgcggcatcatgcaggccgggaagcggagcctgcgcccgcagcccaccgagctgaagtactcctggaagacctggggcaaggccaagatgctcagcaccgagtcctacaaccagacgttcctgatcgacggccccgagaccgcggagtgcccgaacaccaaccgggcctggaacagcctggaggtggaggactacgggttcggcgtcttcaccacgaacatctggctcaagctgaaggagaagcaggacgccttctgcgactccaagctgatgagcgccgccatcaaggacaaccgcgcggtgcacgccgacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccacggtgatcgtcaccgaggactgcgggaaccgcggcccctccctccggaccaccacggccagcggcaagctgatcaccgagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacgcgggtggggaccaagcacgcgatcctcctggccgccgtctccttcgtgaccctgatcaccggcaacatgagcttcaaggacctcgggcgcgtggtcgtgatggtgggcgccacgatggccgacgacatcgggatgggcgtcacctacctggcgctgctcgccgccttcaaggtgcggcccaccttcgccgccggcctgctgctccgcaagctgacctccaaggagctgatgatgacgaccatcgggatcgtgctcctgagccagtccaccatccccgagaccgtcctggagctcacggacgcgctggccctgggcatgatggtgctcaagatcgtgcgcaacatggagaagtaccagctggccgtcaccatcatggccatcctgtgcgtgccgaacgccgtcatcctccagaacgcgtggaaggtgagctgcaccatcctggccgtggtctccgtgagccccctgctcctgacctccagccagcagaagacggactggatccccctggccctcaccatcaaggggctgaaccccaccgccatcttcctgaccacgctctcccggaccaacaagaagcgcagctggccgctgaacgaggcgatcatggccgtgggcatggtctccatcctggccagctccctcctgaagaacgacatccccatgaccggccccctggtggccgggggcctcctgaccgtgtgctacgtcctgacggggcggagcgccgacctcgagctggagcgcgcgaccgacgtgaagtgggaggaccaggccgagatctccggcagcagccccatcctgtccatcaccatcagcgaggacgggtccatgagcatcaagaacgaggaggaggagcagaccctcacgatcctgatccggaccggcctgctcgtgatctccggcctgttcccgatcagcatccccatcaccgccgccgcctggtacctgtgggaggtcaagaagcagcgcgcgggggtgctctgggacgtgcccagcccgccgcccatgggcaaggccgagctggaggacggggcctaccggatcaagcagaagggcatcctggggtacagccagatcggcgccggcgtctacaaggaggggaccttccacaccatgtggcacgtgacgcgcggcgccgtgctcatgcacaaggggaagcggatcgagccctcctgggcggacgtcaagaaggacctgatcagctacggcgggggctggaagctggagggcgagtggaaggagggggaggaggtccaggtgctcgccctggagcccggcaagaacccccgcgccgtccagaccaagcccgggctgttcaagaccaacaccggcacgatcggggccgtgtccctcgacttcagccccggcacctccggcagccccatcatcgacaagaaggggaaggtggtcggcctgtacgggaacggcgtggtgacccggtccggcgcctacgtcagcgcgatcgcccagaccgagaagtccatcgaggacaaccccgagatcgaggacgacatcttccgcaagcggcgcctgacgatcatggacctgcaccccggggccggcaagaccaagcggtacctccccgccatcgtgcgcgaggcgatcaagcgggggctgcgcaccctgatcctcgccccgacccgggtggtcgccgccgagatggaggaggccctgcgcggcctgcccatccggtaccagacgcccgcgatccgcgccgagcacaccgggcgcgagatcgtggacctcatgtgccacgccaccttcaccatgcggctgctgagccccgtgcgcgtcccgaactacaacctcatcatcatggacgaggcccacttcacggaccccgcctccatcgcggcccggggctacatcagcacccgcgtggagatgggcgaggccgccgggatcttcatgaccgccacgccgcccggcagccgggacccgttcccccagtccaacgcgcccatcatcgacgaggagcgcgagatccccgagcggagctggaactccgggcacgagtgggtgacggacttcaagggcaagaccgtctggttcgtgccgagcatcaaggccgggaacgacatcgccgcctgcctgcgcaagaacggcaagaaggtgatccagctgtcccggaagaccttcgacagcgagtacgtcaagacccgcacgaacgactgggacttcgtggtgaccaccgacatctccgagatgggcgcgaacttcaaggccgagcgggtcatcgacccccgccggtgcatgaagcccgtgatcctcaccgacggggaggagcgcgtgatcctggccggccccatgccggtcacgcacagctccgccgcccagcggcgcgggcggatcggccgcaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgggagaaggtggacgccatcgacggcgagtaccgcctgcgcggggaggcccggaagaccttcgtggacctcatgcgccggggcgacctgcccgtctggctggcctacaaggtggcggccgaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgcggccggccggaagtccctgacgctcaacctgatcaccgagatgggccgcctgcccaccttcatgacccagaagacgcgggacgccctcgacaacctggccgtgctgcacaccgcggaggccgggggccgcgcctacaaccacgccctctccgagctgcccgagaccctggagaccctcctgctgctcacgctgctggccaccgtcaccgggggcatcttcctcttcctgatgagcggccgggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacctacgtggtcatcgccatcctgaccgtggtggcggccaccatggccaacgagatgggcttcctggagaagacgaagaaggacctcgggctgggctccatcgccacccagcagccggagagcaacatcctggacatcgacctccggcccgcctccgcgtggaccctgtacgccgtcgccaccacgttcgtgacccccatgctgcgccacagcatcgagaacagctccgtgaacgtcagcctcaccgccatcgccaaccaggcgaccgtgctgatgggcctggggaagggctggcccctctccaagatggacatcggggtgccgctgctggccatcggctgctacagccaggtcaaccccatcacgctcaccgccgccctgctgctcctggtggcgcactacgccatcatcgggcccggcctgcaggccaaggccacccgggaggcccagaagcgcgcggccgccggcatcatgaagaaccccaccgtggacgggatcacggtcatcgacctcgacccgatcccctacgaccccaagttcgagaagcagctgggccaggtgatgctgctcatcctgtgcgtgacccaggtcctgatgatgcggaccacctgggccctctgcgaggccctgacgctggcgaccgggcccatctccaccctctgggagggcaacccggggcgcttctggaacaccacgatcgccgtgagcatggccaacatcttccggggctcctacctggccggcgccgggctcctcttcagcatcatgaagaacaccaccaacacccgccgcggcacggggaacatcggcgagaccctgggcgagaagtggaagtcccggctgaacgcgctcggcaagagcgagttccagatctacaagaagtccggcatccaggaggtggaccgcaccctggccaaggaggggatcaagcggggcgagaccgaccaccacgccgtcagccgcgggtccgccaagctgcggtggttcgtggagcgcaacatggtgacgcccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacctacgggtggaacctcgtgcggctgcagagcggcgtggacgtcttcttcatcccgcccgagaagtgcgacaccctgctctgcgacatcggggagtccagccccaacccgacggtggaggcgggccgcaccctgcgggtgctgaacctcgtcgagaactggctgaacaacaacacccagttctgcatcaaggtgctgaacccctacatgccctccgtgatcgagaagatggaggccctgcagcgcaagtacggcggggccctcgtccggaacccgctgagccgcaacagcacccacgagatgtactgggtgtccaacgccagcggcaacatcgtgtccagcgtcaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcgtaccacggctcctacgagacgaagcagaccgggagcgcctccagcatggtgaacggcgtcgtgcgcctgctcaccaagccgtgggacgtgctgcccaccgtcacgcagatggccatgaccgacaccacccccttcgggcagcagcgcgtgttcaaggagaaggtggacacgcggacccaggagcccaaggagggcaccaagaagctgatgaagatcaccgccgagtggctctggaaggagctgggcaagaagaagacgccgcgcatgtgcacccgggaggagttcacccgcaaggtccggtccaacgccgcgctgggggccatcttcaccgacgagaacaagtggaagtccgcccgcgaggccgtggaggactcccggttctgggagctcgtggacaaggagcgcaacctgcacctggagggcaagtgcgagacgtgcgtctacaacatgatggggaagcgggagaagaagctcggcgagttcgggaaggccaagggcagccgcgcgatctggtacatgtggctgggcgcccggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgccatgtacgcggacgacaccgccgggtgggacacccgcatcaccctcgaggacctgaagaacgaggagatggtgacgaaccacatggagggcgagcacaagaagctggccgaggccatcttcaagctcacctaccagaacaaggtggtccgggtgcagcgccccacgccccgggggaccgtgatggacatcatcagccgccgggaccagcgcggctccgggcaggtcggcacgtacggcctgaacaccttcaccaacatggaggcccagctgatccggcagatggagggggagggcgtgttcaagaacatccagcacctcaccgtgacggaggaggtcgcggtgcacaactggctggcccgcgtggggcgcgagcggctgagccgcatggccatctccggcgacgactgcgtcgtgaagcccctcgacgaccggttcgccaacgccctgaccgcgctgaacgacatgggcaagatccgcaaggacatccagcagtgggagccgagcaaggggtggaacgactggacccaggtgcccttctgctcccaccacttccacgagctcatcatgaaggacggccggatcctggtcgtgccctgccgcaaccaggacgagctgatcgggcgggcccgcatcagccagggcgccgggtggtccctccgggagaccgcctgcctgggcaagagctacgcccagatgtggtccctgatgtacttccaccgccgggacctccgcctggcggccaacgccatctgcagcgccgtgccctcccactgggtcccgacgagccggaccacctggtccatccacgccaagcacgagtggatgaccaccgaggacatgctgacggtgtggaaccgcgtgtggatccgggagaacccctggatggaggacaagacccccgtcgagagctgggaggagatcccctacctcggcaagcgcgaggaccagtggtgcgggtccctgatcggcctgaccagccgggcgacctgggccaagaacatccaggccgccatcaaccaggtgcgctccctcatcgggaacgaggagtacacggactacatgccgagcatgaagcggttccgccgcgaggaggaggaggcgggcgtgctgtggtga

SEQ ID NO: 9551 - RNA, 9876 nt, synthetic construct
  misc_feature 1..9876: note = derived and/or modified CDS sequence (opt1) from DENV-2__FJ547067__SS-prME
  source 1..9876: mol_type = other RNA
agcgccgggatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccatctccttcgtgaccctgatcaccggcaacatgagcttcaaggacctcgggcgggtggtcgtgatggtgggcgccaccatggccgacgacatcgggatgggcgtcacgtacctggccctgctcgcggccttcaaggtgcgccccaccttcgccgccggcctgctgctccggaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggccgtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggcgatcatggccgtgggcatggtgtccatcctggccagctccctcctgaagaacgacatccccatgaccggccccctggtcgccgggggcctcctgaccgtgtgctacgtgctgaccgggcgcagcgccgacctcgagctggagcgggcgacggacgtcaagtgggaggagcaggccgagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggcgggggtcctctgggacgtgcccagcccgccgcccatgggcaaggccgagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggcggacgtgaagaaggacctgatcagctacggcgggggctggaagctggagggcgagtggaaggagggggaggaggtccaggtgctcgccctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgcgatcgcccagaccgagaagtccatcgaggacaaccccgagatcgaggacgacatcttccggaagcgccggctgaccatcatggacctgcaccccggggccggcaagacgaagcgctacctccccgccatcgtccgggaggcgatcaagcgcgggctgcggaccctgatcctcgccccgacccgcgtggtggccgccgagatggaggaggccctgcggggcctgcccatccgctaccagacccccgcgatccgggccgagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgcggcccgcggctacatcagcacgcgggtcgagatgggcgaggccgccgggatcttcatgaccgccacgccgcccggcagccgcgacccgttcccccagtccaacgcgcccatcatcgacgaggagcgggagatccccgagcgcagctggaactccgggcacgagtgggtgaccgacttcaagggcaagacggtgtggttcgtcccgagcatcaaggccgggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgcgaacttcaaggccgagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgcggccgaggggatcaactacgccgaccggcgctggtgcttcgacggcatcaagaacaaccagatcctcgaggagaacgtggaggtggagatctggaccaaggagggggagcggaagaagctgaagccgcgctggctggacgcccggatctactccgaccccctcgccctgaaggagttcaaggagttcgcggccggccgcaagagcctgaccctcaacctgatcacggagatgggccggctgcccaccttcatgacccagaagacccgcgacgccctcgacaacctggccgtcctgcacacggcggaggccgggggccgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcgtccatcctcctgtggtacgcccagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggcggccaccatggccaacgagatgggcttcctggagaagaccaagaaggacctcgggctgggctccatcgccacgcagcagccggagagcaacatcctggacatcgacctccgccccgcctccgcgtggaccctgtacgccgtggccaccaccttcgtcacgcccatgctgcggcacagcatcgagaacagctccgtgaacgtgagcctcaccgccatcgccaaccaggcgaccgtcctgatgggcctggggaagggctggcccctctccaagatggacatcggggtgccgctgctggccatcggctgctacagccaggtgaaccccatcaccctcacggccgccctgctgctcctggtcgcgcactacgccatcatcgggcccggcctgcaggccaaggccacccgcgaggcccagaagcgggcggccgccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggcgacggggcccatctccaccctctgggagggcaacccggggcggttctggaacaccaccatcgccgtcagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgcgctcgggaagtccgagttccaggtgtacaagaagtccggcatccaggaggtggaccggaccctggccaaggaggggatcaagcgcggcgagaccgaccaccacgccgtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgacgaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgaccgtggaggcgggccggacgctgcgcgtgctgaacctcgtcgagaactggctgaacaacaacacccagttctgcatcaaggtgctgaacccctacatgccctccgtgatcgagaagatggaggccctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcgtaccacggctcctacgagaccaagcagacggggagcgcctccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggccggaagaagaccccgcgcatgtgcacgcgggaggagttcacccgcaaggtccggtccaacgccgcgctgggggccatcttcaccgacgagaacaagtggaagtccgcccgcgaggccgtggaggactcccggttctgggagctcgtggacaaggagcgcaacctgcacctggagggcaagtgcgagacctgcgtctacaacatgatggggaagcgggagaagaagctcggcgagttcgggaaggccaagggcagccgcgcgatctggtacatgtggctgggcgcccggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgccatgtacgcggacgacacggccgggtgggacacccgcatcaccctcgaggacctgaagaacgaggagatggtgaccaaccacatggagggcgagcacaagaagctggccgaggccatcttcaagctcacgtaccagaacaaggtggtccgggtgcagcgccccacgccccgggggaccgtgatggacatcatcagccgccgggaccagcgcggctccgggcaggtcggcacctacggcctgaacacgttcaccaacatggaggcccagctgatccggcagatggagggggagggcgtgttcaagagcatccagcacctcaccgtgaccgaggaggtcgcggtgcagaactggctggcccgcgtggggcgcgagcggctgtcccgcatggccatcagcggcgacgactgcgtcgtgaagcccctcgacgaccggttcgccaacgccctgacggcgctgaacgacatgggcaagatccgcaaggacatccagcagtgggagccgtccaaggggtggaacgactggacccaggtgcccttctgcagccaccacttccacgagctcatcatgaaggacggccgggtcctggtggtgccctgccgcaaccaggacgagctgatcgggcgggcccgcatctcccagggcgccgggtggagcctccgggagaccgcctgcctgggcaagtcctacgcccagatgtggagcctgatgtacttccaccgccgggacctccgcctggcggccaacgccatctgctccgccgtccccagccactgggtgccgacctcccggacgacctggagcatccacgccaagcacgagtggatgaccaccgaggacatgctgaccgtgtggaaccgcgtctggatccgggagaacccctggatggaggacaagacgcccgtggagtcctgggaggagatcccctacctcggcaagcgcgaggaccagtggtgcgggagcctgatcggcctgacctcccgggcgacctgggccaagaacatccaggccgccatcaaccaggtgcgcagcctcatcgggaacgaggagtacaccgactacatgccgagcatgaagcggttccgccgcgaggaggaggaggcgggcgtcctgtggtga

SEQ ID NO: 9552 - RNA, 9876 nt, synthetic construct
  misc_feature 1..9876: note = derived and/or modified CDS sequence (opt1) from DENV-2__JN819418__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagaacaaggagctgaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgcggggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgcgatcctcctggtggccgtctccttcatgaccctgatcacggggaacatgagcttccgggacctcggccgcgtgatggtgatggtcggggccaccatgaccgacgacatcggcatgggcgtgacctacctggccctgctcgccgcgttcaaggtgcgccccacgttcgccgccgggctgctgctccggaagctgacctccaaggagctgatgatggccaccatcggcatcgccctcctgagccagtccaccatccccgagacgatcctggagctcaccgacgcgctggccctggggatgatggtcctcaagatcgtgcgcaacatggagaagtaccagctggccgtgaccatcatggccatcagctgcgtcccgaacgccgtgatcctgcagaacgcgtggaaggtgtcctgcaccatcctcgccgccgtcagcgtgagccccctgctgctcacgagctcccagcagaaggccgactggatccccctggcgctgaccatcaagggcctcaaccccaccgccatcttcctgaccacgctgagccggacctccaagaagcgcagctggccgctcaacgaggccatcatggccgtcggcatggtgtccatcctggccagcagcctgctcaagaacgacatccccatgaccgggcccctggtggcgggcgggctgctcaccgtctgctacgtgctgacgggccggtccgccgacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtcatctccggcctcttcccggtgagcatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctacagccagatcggcgccggggtctacaaggagggcaccttccacaccatgtggcacgtgacccgcggggccgtgctgatgcaccgcggcaagcggatcgagccctcctgggccgacgtcaagaaggacctcatcagctacgggggcggctggaagctggagggggagtggaaggagggcgaggaggtccaggtgctggccctcgagcccgggaagaacccccgcgcggtccagacgaagcccggcctgttcaagaccaacaccgggaccatcggcgccgtgtccctggacttcagccccggcacgtccgggagccccatcgtggaccggaagggcaaggtcgtggggctctacggcaacggcgtggtcacccgctccggggcctacgtgagcgccatcgcgcagaccgagaagtccatcgaggacaaccccgagatcgaggacgacatcttccggaagaagcgcctgaccatcatggacctgcaccccggcgccgggaagacgaagcggtacctgcccgccatcgtgcgcgaggccatcaagcggggcctccgcaccctgatcctggccccgacccgcgtcgtggcggccgagatggaggaggccctccgggggctgcccatccgctaccagacccccgccatccgggccgagcacacgggccgcgagatcgtggacctgatgtgccacgcgaccttcaccatgcggctcctgtcccccgtccgcgtgccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggcgggcaacgacatcgccgcctgcctccgcaagaacggcaagaaggtcatccagctgtcccggaagaccttcgacagcgagtacgtgaagacccgcgccaacgactgggacttcgtggtcaccacggacatctccgagatgggggccaacttcaaggcggagcgggtgatcgacccccgccggtgcatgaagcccgtgatcctgaccgacggcgaggagcgcgtcatcctcgccgggcccatgccggtgacccacagctccgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgagcatgttcgagcccgagcgcgagaaggtggacgccatcgacggggagtaccggctgcgcggcgaggcccggaagacgttcgtcgacctgatgcgccgcggggacctccccgtgtggctggcctaccgcgtggccgcggagggcatcaactacgccgaccggcgctggtgcttcgacgggatcaagaacaaccagatcctggaggagaacgtcgaggtggagatctggaccaaggagggcgagcggaagaagctcaagccgcgctggctggacgcccggatctactccgaccccctggccctcaaggagttcaaggagttcgcggccggccgcaagagcctgaccctgaacctcatcaccgagatggggcggctgcccacgttcatgacccagaaggcccgcgacgccctggacaacctcgccgtgctgcacaccgcggaggccggcgggcgggcctacaaccacgccctgtccgagctccccgagaccctggagacgctgctcctgctgaccctcctggccaccgtcaccggcggcatcttcctgttcctcatgagcgggaagggcatcgggaagatgacgctgggcatgtgctgcatcatcaccgcgtccatcctgctctggtacgcccagatccagccgcactggatcgccgccagcatcatcctggagttcttcctgatcgtgctcctgatccccgagcccgagaagcagcgcacgccccaggacaaccagctgacctacgtcgtgatcgccatcctcaccgtggtcgcggccacgatggccaacgagatggggttcctggagaagaccaagaaggacctgggcctcggcagcatcaccacccaggagtccgagagcaacatcctggacatcgacctgcggccggcctccgcctggacgctctacgcggtggccaccaccttcgtgacccccatgctgcgccacagcatcgagaactccagcgtcaacgtgtccctgacggccatcgccaaccaggcgaccgtgctcatggggctgggcaaggggtggcccctgagcaagatggacatcggcgtccccctcctggccatcgggtgctactcccaggtgaacccgatcaccctgaccgccgccctcctgctgctcgtggcccactacgcgatcatcggccccggcctgcaggccaaggccacgcgggaggcccagaagcgcgccgcggccgggatcatgaagaaccccaccgtcgacggcatcaccgtgatcgacctggaccccatcccgtacgaccccaagttcgagaagcagctcggccaggtgatgctgctgatcctctgcgtcacccaggtgctgatgatgcgcacgacctgggccctgtgcgaggccctcaccctggccaccggccccatcagcacgctgtgggaggggaaccccggccggttctggaacaccaccatcgcggtgtccatggccaacatcttccgcggcagctacctcgccggggccggcctgctgttctccatcatgaagaacaccacgaacacccggcgcgggaccggcaacatcggcgagaccctcggggagaagtggaagtcccggctgaacgcgctgggcaagtccgagttccagatctacaagaagtccgggatccaggaggtcgaccgcacgctcgccaaggagggcatcaagcgcggggagaccgaccaccacgccgtgtcccgcggcagcgccaagctgcggtggttcgtggagcgcaacatggtcaccccggagggcaaggtggtggacctggggtgcggccgcggcgggtggtcctactactgcggcgggctcaagaacgtccgcgaggtgaaggggctgaccaagggcgggcccgggcacgaggagcccatccccatgagcacgtacggctggaacctggtgcggctccagagcggggtcgacgtgttcttcaccccgcccgagaagtgcgacaccctgctgtgcgacatcggcgagtccagccccaaccccaccatcgaggccggccgcacgctccgggtgctgaacctggtcgagaactggctcaacaacaacacccagttctgcatcaaggtgctgaacccgtacatgccctccgtgatcgagaagatggagaccctgcagcgcaagtacgggggcgcgctggtccggaaccccctcagccgcaactccacccacgagatgtactgggtgagcaacgccaccgggaacatcgtgtccagcgtcaacatgatctcccggatgctgatcaaccgcttcacgatgaagcacaagaaggccacctacgagccggacgtggacctgggcagcgggacccgcaacatcggcatcgagtccgagatccccaacctcgacatcatcggcaagcggatcgagaagatcaagcaggagcacgagaccagctggcactacgaccaggaccacccctacaagacgtgggcctaccacgggtcctacgagaccaagcagaccggcagcgcctccagcatggtgaacggggtcgtgcgcctgctgaccaagccctgggacgtggtcccgatggtgacgcagatggcgatgaccgacaccacccccttcggccagcagcgggtgttcaaggagaaggtcgacacgcgcacccaggagcccaaggagggcaccaagaagctcatgaagatcaccgccgagtggctgtggaaggagctggggaagaagaagacgccccggatgtgcacccgcgaggagttcacccggaaggtgcgctccaacgccgccctcggcgccatcttcaccgacgagaacaagtggaagtccgcgcgggaggccgtggaggacgggcgcttctgggagctggtcgaccgggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcgcggttcctcgagttcgaggccctggggttcctgaacgaggaccactggttcagccgcgagaacagcctctccggcgtggagggggagggcctgcacaagctgggctacatcctccgggacgtcagcaagaaggagggcggggccatgtacgccgacgacaccgccgggtgggacacccgcatcaccctggaggacctgaagaacgaggagatggtgacgaaccacatggagggcgagcacaagaagctcgcggaggccatcttcaagctgacctaccagaacaaggtcgtgcgggtgcagcgcccgacgccccgggggaccgtcatggacatcatctcccgccgcgaccagcggggcagcggccaggtggggacgtacggcctgaacaccttcaccaacatggaggcccagctcatccgccagatggagggggagggcatcttcaagtccatccagcacctgaccgtgacggaggagatcgccgtccagaactggctggcccgggtgggccgcgagcggctcagccgcatggcgatctccggggacgactgcgtggtcaagcccctggacgaccggttcgccagcgccctgaccgccctcaacgacatgggcaaggtgcgcaaggacatccagcagtgggagccctcccgggggtggaacgactggacccaggtgccgttctgcagccaccacttccacgagctgatcatgaaggacggccgcgtcctggtggtgccctgccggaaccaggacgagctcatcgggcgcgcccggatctcccagggcgcgggctggagcctgaaggagaccgcctgcctggggaagtcctacgcccagatgtggacgctcatgtacttccaccgccgggacctgcgcctggccgccaacgcgatctgcagcgccgtcccctcccactgggtgcccaccagccggaccacctggtccatccacgccaagcacgagtggatgaccacggaggacatgctcgccgtgtggaaccgcgtctggatccaggagaacccgtggatggaggacaagacccccgtggagagctgggaggaggtgccctacctgggcaagcgggaggaccagtggtgcgggagcctgatcggcctcacctcccgcgcgacctgggccaagaacatccagacggccatcaaccaggtccgcagcctgatcgggaacgaggagtacaccgactacatgccctccatgaagcggttccgccgggaggaggaggaggccggcgtgctgtggtga

SEQ ID NO: 9553 - RNA, 9876 nt, synthetic construct
  misc_feature 1..9876: note = derived and/or modified CDS sequence (opt1) from DENV-2__EU482640__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacgaccgtggccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggccctgcaccaggtcttcggggcgatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggccgactccgggtgcgtggtcagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtgacccgcctggagaacctgatgtggcggcagatcacccccgagctcaaccacatcctgtccgagaacgaggtcaagctgacgatcatgaccggggacatcaagggcatcatgcaggccgggaagcgcagcctccggccgcagcccaccgagctgaagtactcctggaaggcctggggcaaggcgaagatgctgagcaccgagctccacaaccacacgttcctgatcgacggccccgagaccgccgagtgcccgaacaccaaccgcgcctggaactccctggaggtggaggactacgggttcggcgtgttcaccacgaacatctggctcaagctgaaggagcggcaggacgtcttctgcgacagcaagctgatgtccgccgccatcaaggacagccgcgcggtgcacgccgacatggggtactggatcgagtccgccctcaacgacacctggaagatcgagaaggccagcttcatcgaggtgaagtcctgccactggcccaagagccacaccctgtggtccaacggcgtcctggagagcgagatgatcatccccaagaacttcgccggccccgtgagccagcacaactaccggccggggtaccacacccagaccgcgggcccctggcacctcgggcgcctggagatggacttcgacttctgcgagggcacgaccgtggtcgtgaccgaggactgcgggaaccggggcccctccctgcgcaccacgaccgccagcggcaagctcatcaccgagtggtgctgccggtcctgcaccctgcccccgctgcgctaccgcggggaggacggctgctggtacgggatggagatccgccccctcaaggagaaggaggagaacctggtgaacagcctggtcacggccggccacgggcagatcgacaacttctccctcggcgtgctgggcatggccctgttcctcgaggagatgctgcggacccgcatcgggaccaagcacgcgatcctgctcgtggccgtcagcttcgtgaccctgatcacgggcaacatgtccttccgcgacctggggcgggtgatggtcatggtgggcgccaccatgaccgacgacatcgggatgggcgtgacctacctcgccctgctggccgcgttcaaggtccgccccacgttcgccgccggcctcctgctgcggaagctcaccagcaaggagctgatgatgaccaccatcgggatcgtgctgctctcccagagcacggtgcccgagaccatcctggagctgaccgacgccctcgccctgggcatgatggtcctgaagatcgtgcgcaacatggagaagtaccagctcgcggtcaccatcatggccatcctgtgcgtgccgaacgccgtgatcctgcagaacgcctggaaggtctcctgcacgaccctcgccgtggtgagcgtcagccccctgctgctcaccagctcccggcagaaggcggactggatccccctggccctgaccatcaaggggctcaaccccacggccatcttcctgaccaccctgagccgcacctccaagaagcggagctggccgctcaacgaggccatcatggcggtgggcatggtgtccatcctggccagcagcctgctcaagaacgacatccccatgacgggccccctggtcgccgggggcctgctcaccgtgtgctacgtgctgaccgggcgctccgccgacctggagctcgagcgggccgcggacgtccgctgggaggagcaggccgagatcagcggctccagccccatcctgtccatcaccatcagcgaggacgggtccatgagcatcaagaacgaggaggaggagcagacgctgaccatcctcatccggaccggcctgctggtgatctccggcctcttcccggtgagcatccccatcaccgccgccgcctggtacctgtgggaggtcaagaagcagcgcgcgggggtgctgtgggacgtgcccagcccgccgcccgtcggcaaggccgagctcgaggacggggcctaccggatcaagcagaagggcatcctggggtacagccagatcggcgccggcgtgtacaaggaggggaccttccacacgatgtggcacgtgacccgcggcgccgtcctgatgcacaaggggaagcggatcgagccctcctgggcggacgtgaagaaggacctcatcagctacggcgggggctggaagctggagggcgagtggaaggagggggaggaggtgcaggtcctggccctcgagcccggcaagaacccccgcgccgtgcagaccaagcccgggctgttcaagaccaacacgggcaccatcggggccgtgtccctggacttcagccccggcacctccggcagccccatcgtcgacaagaaggggaaggtggtgggcctctacgggaacggcgtcgtgacccggtccggcacgtacgtgagcgccatcgcgcagaccgagaagtccatcgaggacaaccccgagatcgaggacgacatcttccgcaagaagcggctgaccatcatggacctgcaccccggggccggcaagaccaagcgctacctgcccgccatcgtccgggaggccatcaagcgcgggctccgcacgctgatcctggcgccgacccgggtggtggccgccgagatggaggaggccctccgcggcctgcccatccggtaccagacccccgccatccgcgcggagcacaccgggcgggagatcgtcgacctgatgtgccacgccacgttcaccatgcgcctcctgtcccccatccgggtgccgaactacaacctgatcatcatggacgaggcccacttcaccgaccccgccagcatcgccgcgcgcggctacatctccacccgggtggagatgggcgaggccgccgggatcttcatgacggccacgccgcccggcagccgcgacccgttcccccagtccaacgcccccatcatggacgaggagcgggagatccccgagcgcagctggaactccgggcacgagtgggtcaccgacttcaagggcaagaccgtgtggttcgtgccgagcatcaaggcggggaacgacatcgccgcctgcctccggaagaacggcaagaaggtcatccagctgtcccgcaagacgttcgacagcgagtacatcaagacccggaccaacgactgggacttcgtggtgaccacggacatctccgagatgggcgccaacttcaaggcggagcgcgtcatcgacccccggcgctgcatgaagcccgtgatcctgaccgacggggaggagcgggtgatcctcgccggccccatgccggtcacccacagctccgccgcccagcgccgcgggcgggtgggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccgcaagacgttcgtcgacctgatgcggcgcggcgacctccccgtgtggctggcctaccgggtcgccgcggaggggatcaactacgccgaccgccggtggtgcttcgacggcgtgaagaacaaccagatcctggaggagaacgtggaggtcgagatctggaccaaggagggggagcgcaagaagctcaagccgcggtggctggacgcccgcatctactccgaccccctggccctcaaggagttcaaggagttcgccgcgggccggaagtccctgaccctgaacctcatcaccgagatgggccgcctgcccacgttcatgacccagaaggcccggaacgccctggacaacctcgccgtgctgcacaccgcggaggccgggggccgcgcctacaaccacgccctgtccgagctccccgagaccctggagacgctgctcctgctgaccctcctggccaccgtgaccgggggcatcttcctgttcctcatgagcggcaaggggatcggcaagatgaccctggggatgtgctgcatcatcacggcgtccatcctgctctggtacgcccagatccagccgcactggatcgccgccagcatcatcctggagttcttcctgatcgtcctcctgatccccgagcccgagaagcagcggacgccccaggacaaccagctgacctacgtggtgatcgccatcctcaccgtcgtggcggccacgatggccaacgagatgggcttcctggagaagaccaagaaggacttcgggctgggcagcatcaccacccagcagccggagtccaacatcctcgacatcgacctgcgccccgccagcgcctggacgctgtacgcggtggccaccaccttcatcacccccatgctccggcactccatcgagaacagctccgtcaacgtgagcctgacggccatcgccaaccaggccaccgtgctgatgggcctcgggaagggctggcccctgtccaagatggacatcggggtcccgctgctcgcgatcggctgctacagccaggtgaaccccatcaccctgaccgccgccctgctcctgctggtggcccactacgcgatcatcgggcccggcctccaggccaaggccacgcgcgaggcccagaagcgcgccgcggccggcatcatgaagaaccccaccgtcgacgggatcaccgtgatcgacctggacccgatcccctacgaccccaagttcgagaagcagctgggccaggtgatgctcctggtcctgtgcgtgacccaggtgctcatgatgcggacgacctgggccctgtgcgaggccctgaccctcgccaccgggcccatctccacgctgtgggagggcaacccggggcgcttctggaacaccaccatcgcggtcagcatggccaacatcttccggggctcctacctggccggcgccgggctcctgttcagcatcatgaagaacaccgccaacacgcgccggggcaccgggaacaccggcgagaccctgggcgagaagtggaagaaccgcctcaacgcgctggggaagtccgagttccagatctacaagaagtccggcatccaggaggtggaccggacgctggccaaggaggggatcaagcgcggcgagaccgaccaccacgccgtgtcccgggggagcgccaagctccgctggttcgtcgagcggaacctggtgacccccgagggcaaggtggtcgacctgggctgcgggcgcggcgggtggtcctactactgcggcgggctcaagaacgtgaaggaggtgaagggcctgaccaagggcgggcccggccacgaggagcccatcccgatgagcacgtacgggtggaacctggtccggctccagtccggcgtggacgtgttcttcacgccgcccgagaagtgcgacaccctgctgtgcgacatcggggagagcagccccaacccgaccgtcgaggcgggccgcaccctccgggtgctgaacctggtggagaactggctcaacaacaacacgcagttctgcatcaaggtcctgaacccctacatgccctccgtgatcgagaagatggaggccctgcagcgcaagtacggcggggccctggtgcggaacccgctcagccgcaactccacccacgagatgtactgggtcagcaacgcctccggcaacatcgtgagctccgtgaacatgatcagccggatgctgatcaaccgcttcaccatgcgccacaagaaggccacctacgagcccgacgtcgacctggggtccggcacgcggaacatcgggatcgagagcgagacccccaacctcgacatcatcggcaagcgcatcgagaagatcaagcaggagcacgagacctcctggcactacgaccaggaccacccctacaagacctgggcgtaccacggcagctacgagacgaagcagaccgggtccgccagctccatggtgaacggcgtggtccggctgctgaccaagccgtgggacgtgatccccatggtgacccagatggccatgacggacaccacccccttcgggcagcagcgcgtcttcaaggagaaggtggacacccggacgcaggagcccaaggagggcaccaagaagctcatgaagatcaccgccgagtggctgtggaaggagctgggcaagaagaagaccccgcgcatgtgcacgcgggaggagttcacccgcaaggtccggagcaacgccgcgctcggggccatcttcaccgacgagaacaagtggaagtccgcccgcgaggccgtggaggacagcggcttctgggagctggtggacaaggagcggaacctgcacctcgaggggaagtgcgagacctgcgtctacaacatgatgggcaagcgcgagaagaagctgggggagttcggcaaggccaagggctcccgggcgatctggtacatgtggctgggggcccgcttcctcgagttcgaggccctgggcttcctgaacgaggaccactggttcagccgggagaacagcctctccggggtggagggcgaggggctgcacaagctgggctacatcctccgcgacgtgagcaagaaggagggcggggccatgtacgcggacgacacggccggctgggacacccggatcaccctggaggacctgaagaacgaggagatggtcaccaaccacatggagggggagcacaagaagctcgccgaggccatcttcaagctgacgtaccagaacaaggtggtgcgcgtccagcggcccacgccccggggcaccgtgatggacatcatctcccggcgcgaccagcgcgggagcggccaggtggtcacctacggcctgaacacgttcaccaacatggaggcccagctcatccggcagatggagggggagggcgtgttcaagtccatccagcagctgaccgtgaccgaggagatcgcggtcaagaactggctggcccgcgtggggcgggagcgcctcagccggatggccatctccggcgacgactgcgtggtcaagcccctggacgaccgcttcgccagcgccctgacggcgctcaacgacatgggcaaggtgcggaaggacatccagcagtgggagccgtcccgcgggtggaacgactggacccaggtgcccttctgcagccaccacttccacgagctgatcatgaaggacggccgggtcctggtggtgccctgccgcaaccaggacgagctcatcgggcgggcccgcatctcccagggcgccgggtggagcatgcgggagaccgcctgcctgggcaagtcctacgcccagatgtggagcctgatgtacttccaccgccgggacctccgcctggcggccaacgccatctgctccgccgtccccagccactgggtgccgacctcccggaccacgtggagcatccacgccacccacgagtggatgaccaccgaggacatgctgacggtgtggaaccgcgtctggatccaggagaacccctggatggaggacaagacccccgtggagagctgggaggagatcccctacctcggcaagcgggaggaccagtggtgcgggtccctgatcggcctgaccagccgcgcgacctgggccaagaacatccagacggccatcaaccaggtgcgctccctcatcgggaacgaggagtacaccgactacatgccgagcatgaagcggttccgccgggaggaggaggaggccggcgtcctgtggtga

SEQ ID NO: 9554 - RNA, 9876 nt, synthetic construct
  misc_feature 1..9876: note = derived and/or modified CDS sequence (opt1) from DENV-2__EU482641__SS-prME
  source 1..9876: mol_type = other RNA
agcgcgggcatgatcatcatgctgatccccaccgtgatggccttccacctcaccacccgcaacggggagccccacatgatcgtcggcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacggcacgtgcaccatcaccggcgagcaccgccgggagaagcgcagcgtcgccctggtgccccacgtggggatgggcctcgagacccggacggagacctggatgtccagcgagggggcctggaagcacgcccagcgcatcgagacctggatcctgcggcacccgggcttcaccatcatggccgcgatcctggcctacacgatcgggaccacccacttccagcgcgtcctcatcttcatcctgctgaccgccgtggccccctccatgacgatgcggtgcatcggcatcagcaaccgcgacttcgtggagggcgtctccgggggcagctgggtggacatcgtgctcgagcacgggtcctgcgtcaccaccatggcgaagaacaagcccaccctggacttcgagctgatcaagacggaggccaagcagcccgccaccctccggaagtactgcatcgaggccaagctgaccaacaccacgaccgagagccgctgccccacccagggcgagccctccctgaaggaggagcaggacaagcggttcgtgtgcaagcacagcatggtggaccgcggctgggggaacggctgcggcctgttcggcaagggcgggatcgtgacctgcgccatgttcacgtgcaagaagaacatggagggcaagatcgtgcagcccgagaacctggagtacaccatcgtggtcacgccccactccggggaggagcacgcggtgggcaacgacaccgggaagcacggcatggagatcaaggtgacgccgcagagctccatcaccgaggccgagctgaccgggtacggcaccgtcaccatggagtgcagcccccggacgggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacaccgccctgacgggcgccaccgagatccagatgagctccgggaacctcctgttcaccggccacctgaagtgccggctgcgcatggacaagctccagctgaagggcatgagctactccatgtgcaccgggaagttcaaggtggtcaaggagatcgccgagacgcagcacggcaccatcgtgatccgggtgcagtacgagggggacggcagcccctgcaagatccccttcgagatcatggacctggagaagcgctacgtcctcggccggctgatcaccgtgaacccgatcgtgaccgagaaggactcccccgtcaacatcgaggccgagccgcccttcggggacagctacatcatcatcggcgtggagccggggcagctgaagctcaactggttcaagaagggctccagcatcgggcagatgttcgagacgaccatgcgcggcgcgaagcgcatggccatcctgggcgacaccgcctgggacttcgggtccctgggcggggtgttcaccagcatcggcaaggccctccaccaggtcttcggggccatctacggcgcggccttctccggcgtgagctggacgatgaagatcctgatcggggtgatcatcacctggatcggcatgaactcccggagcacctccctgagcgtctccctggtgctcgtggggatcgtcaccctgtacctgggcgtgatggtgcaggccgacagcgggtgcgtcgtgtcctggaagaacaaggagctcaagtgcggcagcggcatcttcatcacggacaacgtgcacacctggaccgagcagtacaagttccagcccgagagcccctccaagctggccagcgcgatccagaaggcccaggaggaggggatctgcggcatccgctccgtcacccggctggagaacctcatgtggaagcagatcacgcccgagctgaaccacatcctggccgagaacgaggtgaagctcaccatcatgaccggggacatccgcggcatcatgcaggccgggaagcggagcctgcgcccgcagcccaccgagctgaagtactcctggaagacgtggggcaaggccaagatgctcagcaccgagtcctacaaccagaccttcctgatcgacggccccgagaccgcggagtgcccgaacacgaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacctggaagatcgagaaggccagcttcatcgaggtgaagaactgccactggcccaagtcccacacgctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcaccgaggactgcgggaaccgcggcccctccctccggacgaccaccgccagcggcaagctgatcaccgagtggtgctgccgcagctgcacgctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggaccaagcacgcgatcctcctggtcgccgtgtccttcgtgacgctgatcaccggcaacatgagcttcaaggacctcgggcgcgtcgtggtgatggtcggcgccaccatggccgacgacatcgggatgggcgtgacctacctggccctgctcgcggccttcaaggtgcggcccacgttcgccgccggcctgctgctccgcaagctgacctccaaggagctgatgatgaccaccatcgggatcgtcctcctgagccagtccacgatccccgagaccgtgctggagctcaccgacgccctggcgctgggcatgatggtgctcaagatcgtccgcaacatggagaagtaccagctggccgtgaccatcatggccatcctgtgcgtcccgaacgccgtgatcctccagaacgcctggaaggtgagctgcacgatcctggcggtcgtgtccgtgagccccctgctcctgacctccagccagcagaagaccgactggatccccctggccctcaccatcaaggggctgaaccccacggccatcttcctgaccaccctctcccggaccaacaagaagcgcagctggccgctgaacgaggccatcatggcggtcggcatggtgtccatcctggccagctccctcctgaagaacgacatccccatgacgggccccctggtggccgggggcctcctgaccgtctgctacgtgctgaccgggcggagcgccgacctcgagctggagcgcgccaccgacgtgaagtgggaggaccaggcggagatctccggcagcagccccatcctgtccatcacgatcagcgaggacgggtccatgagcatcaagaacgaggaggaggagcagaccctcaccatcctgatccggaccggcctgctcgtcatctccggcctgttcccgatcagcatccccatcacggccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagaccaagcccgggctgttcaagacgaacaccggcaccatcggggccgtgtccctcgacttcagccccggcacctccggcagccccatcatcgacaagaaggggaaggtcgtgggcctgtacgggaacggcgtggtcacgcggtccggcgcctacgtgagcgccatcgcgcagaccgagaagtccatcgaggacaaccccgagatcgaggacgacatcttccgcaagcggcgcctgaccatcatggacctgcaccccggggccggcaagaccaagcggtacctccccgccatcgtgcgcgaggccatcaagcgggggctgcgcacgctgatcctcgcgccgacccgggtcgtggccgccgagatggaggaggccctgcgcggcctgcccatccggtaccagacccccgccatccgcgcggagcacaccgggcgcgagatcgtggacctcatgtgccacgccacgttcaccatgcggctgctgagccccgtccgcgtgccgaactacaacctcatcatcatggacgaggcccacttcaccgaccccgcctccatcgccgcgcggggctacatcagcacccgcgtggagatgggcgaggccgccgggatcttcatgacggccacgccgcccggcagccgggacccgttcccccagtccaacgcccccatcatcgacgaggagcgcgagatccccgagcggagctggaactccgggcacgagtgggtcaccgacttcaagggcaagaccgtgtggttcgtgccgagcatcaaggcggggaacgacatcgccgcctgcctgcgcaagaacggcaagaaggtcatccagctgtcccggaagacgttcgacagcgagtacgtgaagacccgcaccaacgactgggacttcgtggtcaccacggacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgggagaaggtggacgccatcgacggcgagtaccgcctgcgcggggaggcccggaagacgttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcaccgagatgggccgcctgcccacgttcatgacccagaagacccgggacgccctcgacaacctggccgtcctgcacaccgccgaggccggcgggcgcgcctacaaccacgccctctccgagctgcccgagacgctggagaccctcctgctgctcaccctgctggccaccgtgaccggcgggatcttcctcttcctgatgagcgggcgggggatcgggaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacctacgtcgtgatcgccatcctgacggtggtcgccgcgaccatggccaacgagatgggcttcctggagaagaccaagaaggacctcgggctgggctccatcgccacccagcagccggagagcaacatcctggacatcgacctccggcccgcctccgcctggacgctgtacgcggtggccaccaccttcgtgacccccatgctgcgccacagcatcgagaacagctccgtcaacgtgagcctcacggccatcgccaaccaggccaccgtgctgatgggcctggggaagggctggcccctctccaagatggacatcggggtcccgctgctggcgatcggctgctacagccaggtgaaccccatcaccctcaccgccgccctgctgctcctggtggcccactacgcgatcatcgggcccggcctgcaggccaaggccacgcgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggacgacctgggccctctgcgaggccctgaccctggccaccgggcccatctccacgctctgggagggcaacccggggcgcttctggaacaccaccatcgcggtgagcatggccaacatcttccggggctcctacctggccggcgccgggctcctcttcagcatcatgaagaacaccacgaacacccgccgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggcccggccacgaggagcccatcccgatgtccacgtacgggtggaacctcgtgcggctgcagagcggcgtcgacgtgttcttcatcccgcccgagaagtgcgacaccctgctctgcgacatcggggagtccagccccaacccgaccgtggaggccggccgcaccctgcgggtcctgaacctcgtggagaactggctgaacaacaacacgcagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacccgcaacatcgggatcgagtccgagatccccaacctggacatcatcggcaagcggatcgagaagatcaagcaggagcacgagacgagctggcactacgaccaggaccacccctacaagacctgggcctaccacggctcctacgagaccaagcagaccgggagcgcgtccagcatggtcaacggcgtggtgcgcctgctcacgaagccgtgggacgtcctgcccaccgtgacccagatggccatgaccgacacgacccccttcgggcagcagcgcgtgttcaaggagaaggtcgacacccggacccaggagcccaaggagggcacgaagaagctgatgaagatcaccgccgagtggctctggaaggagctgggcaagaagaagaccccgcgcatgtgcacccgggaggagttcacgcgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgcggggtgggacacgcgcatcaccctcgaggacctgaagaacgaggagatggtgaccaaccacatggagggcgagcacaagaagctggccgaggccatcttcaagctcacctaccagaacaaggtcgtgcgggtgcagcgccccacgccccgggggaccgtcatggacatcatcagccgccgggaccagcgcggctccgggcaggtcggcacctacggcctgaacaccttcacgaacatggaggcccagctgatccggcagatggagggggagggcgtgttcaagaacatccagcacctcaccgtcaccgaggaggtggccgtgcacaactggctggcgcgcgtcgggcgcgagcggctgagccgcatggccatctccggcgacgactgcgtggtgaagcccctcgacgaccggttcgccaacgccctgaccgccctgaacgacatgggcaagatccgcaaggacatccagcagtgggagccgagcaaggggtggaacgactggacgcaggtccccttctgctcccaccacttccacgagctcatcatgaaggacggccggatcctggtggtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtcccctcccactgggtgccgaccagccggaccacgtggtccatccacgccaagcacgagtggatgaccaccgaggacatgctgaccgtgtggaaccgcgtctggatccgggagaacccctggatggaggacaagacccccgtggagagctgggaggagatcccctacctcggcaagcgcgaggaccagtggtgcgggtccctgatcggcctgacgagccgggccacctgggcgaagaacatccaggccgccatcaaccaggtgcgctccctcatcgggaacgaggagtacaccgactacatgccgagcatgaagcggttccgccgcgaggaggaggaggccggcgtcctgtggtga

SEQ ID NO: 9555 - RNA, 9876 nt, synthetic construct
  misc_feature 1..9876: note = derived and/or modified CDS sequence (opt1) from DENV-2__EU482642__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgttcgagctgaccgacgccctcgcgctgggcatgatggtgctgaagatcgtccgcaacatggagaagtaccagctcgccgtgacgatcatggccatcctgtgcgtcccgaacgccgtgatcctgcagaacgcctggaaggtgagctgcaccatcctcgcggtcgtgtccgtgagccccctgctgctcacctccagccagcagaagaccgactggatccccctggccctgacgatcaaggggctcaaccccaccgccatcttcctgaccaccctgtcccgcacgaacaagaagcggagctggccgctcaacgaggccatcatggcggtcggcatggtgtccatcctggccagctccctgctcaagaacgacatccccatgaccggccccctggtggccgggggcctgctcaccgtctgctacgtgctgaccgggcgcagcgccgacctggagctcgagcgggccacggacgtgaagtgggaggaccaggcggagatctccggcagcagccccatcctgtccatcaccatcagcgaggacgggtccatgagcatcaagaacgaggaggaggagcagaccctgaccatcctcatccgcacgggcctgctggtcatctccggcctcttcccgatcagcatccccatcaccgccgccgcctggtacctgtgggaggtgaagaagcagcgggccggggtgctgtgggacgtccccagcccgccgcccatgggcaaggcggagctcgaggacggggcctaccgcatcaagcagaagggcatcctggggtacagccagatcggcgccggcgtgtacaaggaggggaccttccacaccatgtggcacgtgacccggggcgccgtcctgatgcacaaggggaagcgcatcgagccctcctgggccgacgtgaagaaggacctcatcagctacggcgggggctggaagctggagggcgagtggaaggagggggaggaggtgcaggtcctggcgctcgagcccggcaagaacccccgggccgtgcagacgaagcccgggctgttcaagaccaacaccggcaccatcggggccgtgtccctggacttcagccccggcacgtccggcagccccatcatcgacaagaaggggaaggtcgtgggcctctacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctgcccgccatcgtgcgggaggccatcaagcgcgggctccggaccctgatcctggcgccgacccgcgtcgtggccgccgagatggaggaggccctccggggcctgcccatccgctaccagacccccgccatccgggcggagcacacggggcgcgagatcgtggacctgatgtgccacgccaccttcaccatgcgcctcctgagccccgtccgggtgccgaactacaacctgatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctccggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctgaccgacggggaggagcgggtcatcctcgccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctgctcgacaacatcaacacgcccgagggcatcatcccgagcatgttcgagcccgagcgcgagaaggtggacgccatcgacggcgagtaccggctgcgcggggaggcccgcaagaccttcgtcgacctgatgcggcgcggcgacctccccgtgtggctggcctacaaggtggccgcggaggggatcaactacgccgaccggcgctggtgcttcgacggcatcaagaacaaccagatcctggaggagaacgtcgaggtggagatctggaccaaggagggggagcggaagaagctcaagccgcgctggctggacgcccggatctactccgaccccctggccctcaaggagttcaaggagttcgccgcgggccgcaagagcctgaccctgaacctcatcacggagatgggccggctgcccaccttcatgacccagaagacccgcgacgccctggacaacctcgccgtcctgcacacggccgaggccggcgggcgggcctacaaccacgccctgtccgagctccccgagaccctggagaccctgctcctgctgaccctcctggccacggtgaccgggggcatcttcctgttcctcatgagcggccgcgggatcggcaagatgaccctggggatgtgctgcatcatcaccgcctccatcctgctctggtacgcgcagatccagccgcactggatcgccgccagcatcatcctggagttcttcctgatcgtgctcctgatccccgagcccgagaagcagcggacgccccaggacaaccagctgacgtacgtcgtgatcgccatcctcaccgtggtcgccgcgaccatggccaacgagatgggcttcctggagaagaccaagaaggacctggggctcggctccatcgccacgcagcagccggagagcaacatcctggacatcgacctgcgccccgcctccgcctggaccctctacgcggtggccaccaccttcgtgacgcccatgctgcggcacagcatcgagaacagctccgtcaacgtgagcctgaccgccatcgccaaccaggccaccgtgctcatgggcctggggaagggctggcccctgtccaagatggacatcggggtcccgctcctggcgatcggctgctacagccaggtgaaccccatcaccctgacggccgccctcctgctgctcgtggcccactacgcgatcatcgggcccggcctgcaggccaaggccacccgcgaggcccagaagcgggccgcggccggcatcatgaagaaccccaccgtcgacgggatcaccgtgatcgacctggacccgatcccctacgaccccaagttcgagaagcagctcggccaggtgatgctgctgatcctctgcgtcacccaggtgctgatgatgcgcaccacctgggccctgtgcgaggccctcaccctggccacggggcccatctccaccctgtgggagggcaacccggggcggttctggaacaccaccatcgcggtgagcatggccaacatcttccgcggctcctacctcgccggcgccgggctgctgttcagcatcatgaagaacacgaccaacacccggcgcggcaccgggaacatgggcgagacgctcggcgagaagtggaagtcccgcctgaacgccctggggaagtccgagttccagatctacaagaagtccggcatccaggaggtcgaccggaccctcgcgaaggaggggatcaagcgcggcgagaccgaccaccacgccgtgagccgggggtccgccaagctgcgctggttcgtggagcggaacatggtcacccccgagggcaaggtggtggacctgggctgcgggcgcggcgggtggagctactactgcggcgggctcaagaacgtccgggaggtgaagggcctgacgaagggcgggcccggccacgaggagcccatcccgatgtccacctacgggtggaacctggtgcgcctccagagcggcgtcgacgtgttcttcatcccgcccgagaagtgcgacaccctgctgtgcgacatcggggagtccagccccaacccgaccgtggaggccggccggacgctccgcgtcctgaacctggtggagaactggctcaacaacaacacccagttctgcatcaaggtgctgaacccctacatgccctccgtcatcgagaagatggaggcgctgcagcggaagtacggcggggccctggtgcgcaacccgctcagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctggggagcggcacgcggaacatcgggatcgagtccgagatccccaacctcgacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcggctgctgaccaagccgtgggacgtcctccccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctgtggaaggagctcggcaagaagaagaccccgcggatctgcacgcgcgaggagttcacccggaaggtgcgctccaacgccgccctgggggcgatcttcaccgacgagaacaagtggaagtccgcccgggaggccgtggaggactcccgcttctgggagctggtcgacaaggagcggaacctccacctggagggcaagtgcgagacctgcgtgtacaacatgatggggaagcgcgagaagaagctgggcgagttcgggaaggccaagggcagccgggccatctggtacatgtggctcggcgcgcgcttcctggagttcgaggccctggggttcctcaacgaggaccactggttctcccgggagaacagcctgtccggcgtcgagggggagggcctgcacaagctcgggtacatcctgcgcgacgtgagcaagaaggagggcggcgccatgtacgccgacgacacggcggggtgggacacccggatcaccctggaggacctcaagaacgaggagatggtgaccaaccacatggagggcgagcacaagaagctggccgaggccatcttcaagctgacgtaccagaacaaggtcgtgcgcgtgcagcggcccacgccccgggggaccgtcatggacatcatcagccggaaggaccagcgcggctccggccaggtggggacctacggcctcaacacgttcaccaacatggaggcccagctgatccggcagatggagggggagggcgtgttcaagaacatccagcacctgaccgtcaccgaggaggtggccgtgcagaactggctcgcgcgcgtcgggcgggagcgcctgagccgcatggccatctccggcgacgactgcgtggtgaagcccctggacgaccggttcgccaacgccctcacggccctgaacgacatgggcaagatccgcaaggacatccagcagtgggagccgagcaaggggtggaacgactggacccaggtccccttctgctcccaccacttccacgagctgatcatgaaggacggccgggtgctcgtggtcccctgccgcaaccaggacgagctgatcgggcgggcgcgcatcagccagggcgccgggtggtccctgcgggagaccgcctgcctcggcaagagctacgcccagatgtggtccctgatgtacttccaccgccgggacctgcgcctcgccgcgaacgccatctgcagcgccgtgccctcccactgggtgccgaccagccggacgacctggtccatccacgccaagcacgagtggatgaccaccgaggacatgctgaccgtctggaaccgcgtgtggatccaggagaacccctggatggaggacaagacgcccgtggagagctgggaggagatcccctacctgggcaagcgggaggaccagtggtgcgggtccctcatcggcctgaccagccgcgccacctgggcgaagaacatccaggccgccatcaaccaggtccggtccctgatcgggaacgaggagtacaccgactacatgccgagcatgaagcgcttccggcgcgaggaggaggaggccggcgtgctctggtga

SEQ ID NO: 9556 - RNA, 9876 nt, synthetic construct
  misc_feature 1..9876: note = derived and/or modified CDS sequence (opt1) from DENV-2__EU482643__SS-prME
  source 1..9876: mol_type = other RNA
agcgcgggcatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatgaagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcaccgtgtccttcgtgaccctgatcacgggcaacatgagcttcaaggacctcgggcgggtcgtggtgatggtcggcgcgaccatggccgacgacatcgggatgggcgtgacctacctggccctgctcgccgccttcaaggtgcgccccaccttcgcggccggcctgctgctccggaagctgacgtccaaggagctgatgatgaccaccatcgggatcgtcctcctgagccagtccaccatccccgagacggtgctggagctcaccgacgccctggccctgggcatgatggtgctcaagatcgtccgcaacatggagaagtaccagctggccgtgaccatcatggcgatcctgtgcgtcccgaacgccgtgatcctccagaacgcctggaaggtgagctgcaccatcctggccgtcgtgtccgtgagccccctgctcctgacgtccagccagcagaagaccgactggatccccctggccctcaccatcaaggggctgaaccccaccgcgatcttcctgacgaccctctcccgcaccaacaagaagcggagctggccgctgaacgaggccatcatggccgtcggcatggtgtccatcctggccagctccctcctgaagaacgacatccccatgaccggccccctggtggccggcgggctcctgacggtctgctacgtgctgaccgggcgcagcgccgacctcgagctggagcgggccaccgacgtgaagtgggaggaccaggccgagatctccgggagcagccccatcctgtccatcaccatcagcgaggacgggtccatgagcatcaagaacgaggaggaggagcagacgctcaccatcctgatccgcaccggcctgctcgtcatctccggcctgttcccgatcagcatccccatcaccgccgcggcctggtacctgtgggaggtgaagaagcagcgggccggggtgctctgggacgtccccagcccgccgcccatgggcaaggccgagctggaggacggggcctaccgcatcaagcagaagggcatcctggggtacagccagatcggcgcgggcgtgtacaaggaggggaccttccacacgatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggccgtgcagaccaagcccgggctgttcaagaccaacacgggcaccatcggggcggtgtccctcgacttcagccccggcacctccggcagccccatcatcgacaagaaggggaaggtcgtgggcctgtacgggaacggcgtggtcacccgctccggcgcctacgtgagcgccatcgcccagacggagaagtccatcgaggacaaccccgagatcgaggacgacatcttccggaagcgccggctgaccatcatggacctgcaccccggggccggcaagaccaagcgctacctccccgcgatcgtgcgggaggccatcaagcgcgggctgcggaccctgatcctcgccccgacgcgcgtcgtggccgcggagatggaggaggccctgcggggcctgcccatccgctaccagacccccgccatccgggccgagcacaccgggcgcgagatcgtggacctcatgtgccacgccaccttcacgatgcgcctgctgagccccgtccgggtgccgaactacaacctcatcatcatggacgaggcgcacttcaccgaccccgcctccatcgccgcccgcggctacatcagcacccgggtggagatgggcgaggccgcggggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagaccgtgtggttcgtgccgagcatcaaggccgggaacgacatcgccgcgtgcctgcggaagaacggcaagaaggtcatccagctgtcccgcaagaccttcgacagcgagtacgtgaagacgcggaccaacgactgggacttcgtggtcaccaccgacatctccgagatgggcgccaacttcaaggccgagcgcgtgatcgacccccggcgctgcatgaagcccgtgatcctcacggacggggaggagcgggtcatcctggccggccccatgccggtgacccacagctccgcggcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgccatcgacggcgagtaccggctgcgcggggaggcgcgcaagaccttcgtcgacctcatgcggcgcggcgacctgcccgtgtggctggcctacaaggtggccgccgaggggatcaactacgccgaccggcgctggtgcttcgacggcatcaagaacaaccagatcctcgaggagaacgtcgaggtggagatctggacgaaggagggggagcggaagaagctgaagccgcgctggctggacgcgcggatctactccgaccccctcgccctgaaggagttcaaggagttcgccgccggccgcaagagcctgaccctcaacctgatcaccgagatgggccggctgcccaccttcatgacgcagaagacccgcgacgccctcgacaacctggcggtcctgcacaccgccgaggccgggggccgggcctacaaccacgcgctctccgagctgcccgagaccctggagacgctcctgctgctcaccctgctggccaccgtgaccgggggcatcttcctcttcctgatgagcggccgcgggatcggcaagatgaccctggggatgtgctgcatcatcacggcctccatcctcctgtggtacgcccagatccagccgcactggatcgccgcgagcatcatcctggagttcttcctcatcgtgctgctgatccccgagcccgagaagcagcggacgccccaggacaaccagctcacctacgtcgtgatcgccatcctgaccgtggtcgccgccacgatggccaacgagatgggcttcctggagaagaccaagaaggacctcgggctgggctccatcgcgacccagcagccggagagcaacatcctggacatcgacctccgccccgcctccgcctggaccctgtacgccgtggccacgaccttcgtgacccccatgctgcggcacagcatcgagaacagctccgtcaacgtgagcctcaccgcgatcgccaaccaggccacggtgctgatgggcctggggaagggctggcccctctccaagatggacatcggggtcccgctgctggccatcggctgctacagccaggtgaaccccatcaccctcaccgccgcgctgctgctcctggtggcccactacgccatcatcgggcccggcctgcaggccaaggcgacccgcgaggcccagaagcgggccgccgccggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggcgctctgcgaggccctgaccctggccaccgggcccatctccaccctctgggagggcaacccggggcggttctggaacacgaccatcgccgtgagcatggccaacatcttccgcggctcctacctggcgggcgccgggctcctcttcagcatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtcgaccggaccctggccaaggaggggatcaagcgcggcgagacggaccaccacgccgtgagccgggggtccgcgaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacacgctgctctgcgacatcggggagtccagccccaacccgaccgtggaggccggccggaccctgcgcgtcctgaacctcgtggagaactggctgaacaacaacacccagttctgcatcaaggtgctgaacccctacatgccctccgtcatcgagaagatggaggccctgcagcggaagtacggcggggccctcgtgcgcaacccgctgagccggaacagcacccacgagatgtactgggtgtccaacgcgagcggcaacatcgtctccagcgtgaacatgatctcccgcatgctgatcaaccggttcacgatgcgccacaagaaggccacctacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacgtgggcctaccacggctcctacgagaccaagcagaccgggagcgcctccagcatggtcaacggcgtggtgcggctgctcaccaagccgtgggacgtcctgcccacggtgacccagatggccatgaccgacaccacgcccttcgggcagcagcgcgtgttcaaggagaaggtcgacacccgcacccaggagcccaaggagggcaccaagaagctgatgaagatcacggcggagtggctctggaaggagctgggcaagaagaagaccccgcggatgtgcacccgcgaggagttcacccggaaggtgcgctccaacgccgccctgggggccatcttcacggacgagaacaagtggaagtccgcccgggaggcggtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcccgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgcgatgtacgccgacgacaccgccgggtgggacacccggatcacgctcgaggacctgaagaacgaggagatggtgaccaaccacatggagggcgagcacaagaagctggccgaggcgatcttcaagctcacctaccagaacaaggtcgtgcgcgtgcagcggcccacgccccgggggacggtcatggacatcatcagccggcgcgaccagcggggctccggccaggtggggacctacggcctgaacaccttcaccaacatggaggcccagctgatccgccagatggagggggagggcgtgttcaagaacatccagcacctcacggtcaccgaggaggtggccgtgcagaactggctggcccgggtcgggcgcgagcgcctgagccggatggccatctccggcgacgactgcgtggtgaagcccctcgacgaccgcttcgcgaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgccgggtggtccctccgcgagacggcgtgcctgggcaagagctacgcccagatgtggtccctgatgtacttccaccggcgcgacctccggctggccgccaacgccatctgcagcgcggtgccctcccactgggtgccgaccagccgcaccacctggtccatccacgccaagcacgagtggatgaccacggaggacatgctgaccgtctggaaccgggtgtggatccgcgacaacccctggatggaggacaagacccccgtggagagctgggaggagatcccctacctcggcaagcgggaggaccagtggtgcgggtccctgatcggcctgaccagccgcgccacgtgggccaagaacatccaggccgcgatcaaccaggtccggtccctcatggggaacgaggagtacaccgactacatgccgagcatgaagcgcttccggcgcgaggaggaggaggccggcgtgctgtggtga

SEQ ID NO: 9557 - RNA, 9876 nt, synthetic construct
  misc_feature 1..9876: note = derived and/or modified CDS sequence (opt1) from DENV-2__EU482644__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggacgggcgtgacctacctggccctgctcgcggccttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggcgctgggcatgatggtgctcaagatcgtccgcaacatggagaagtaccagctggccgtgaccatcatgaccatcctgtgcgtcccgaacgccgtgatcctccagaacgcctggaaggtgagctgcaccatcctggccgtcgtgtccgtgagccccctgctcctgacgtccagccagcagaagaccgactggatccccctggcgctcaccatcaaggggctgaaccccaccgccatcttcctgacgaccctctcccgcaccaacaagaagcggagctggccgctgaacgaggccatcatggccgtcggcatggtgtccatcctggcgagctccctcctgaagaacgacatccccatgaccggccccctggtggccgggggcctcctgacggtctgctacgtgctgaccgggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagacgctcaccatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacacgatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacacgggcaccatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagacggagaagtccatcgaggacaaccccgagatcgaggacgacatcttccggaagcgccggctgaccatcatggacctgcaccccggggcgggcaagaccaagcgctacctccccgccatcgtgcgggaggccatcaagcgcgggctgcggaccctgatcctcgccccgacgcgcgtcgtggcggccgagatggaggaggccctgcggggcctgcccatccgctaccagacccccgccatccgggccgagcacaccgggcgcgagatcgtggacctcatgtgccacgcgaccttcacgatgcgcctgctgagccccgtccgggtgccgaactacaacctcatcatcatggacgaggcccacttcaccgaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacgcggaccaacgactgggacttcgtggtcaccaccgacatctccgagatgggcgccaacttcaaggccgagcgcgtgatcgacccccggcgctgcatgaagcccgtgatcctcacggacggggaggagcgggtcatcctggcgggccccatgccggtgacccacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggacgaaggagggggagcggaagaagctgaagccgcgctggctggacgcccggatctactccgaccccctcgccctgaaggagttcaaggagttcgccgccggccgcaagagcctgaccctcaacctgatcaccgagatgggccggctgcccaccttcatgacgcagaagacccgcgacgcgctcgacaacctggccgtcctgcacaccgccgaggccgggggccgggcgtacaaccacgccctctccgagctgcccgagaccctggagacgctcctgctgctcaccctgctggccaccgtgaccgggggcatcttcctcttcctgatgagcggccgcgggatcggcaagatgaccctggggatgtgctgcatcatcacggcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccacgatggcgaacgagatgggcttcctggagaagaccaagaaggacctcgggctgggctccatcgccacccagcagccggagagcaacatcctggacatcgacctccgccccgcctccgcctggaccctgtacgccgtggcgacgaccttcgtgacccccatgctgcggcacagcatcgagaacagctccgtcaacgtgagcctcaccgccatcgccaaccaggccacggtgctgatgggcctggggaagggctggcccctctccaagatggacatcggggtcccgctgctggccatcggctgctacagccaggtgaaccccatcaccctcaccgcggccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaacccggggcggttctggaacacgaccatcgccgtgagcatggcgaacatcttccgcggctcctacctggccggcgccgggctcctcttcagcatcatgaagaacaccaccaacacgcggcgcggcaccgggaacatgggcgagaccctgggcgagaagtggaagtcccgcctgaacgccctcgggaagtccgagttccagatctacaagaagtccggcatccaggaggtcgaccggaccctggccaaggaggggatcaagcgcggcgagacggaccaccacgcggtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacacgctgctctgcgacatcggggagtccagccccaacccgaccgtggaggccggccggaccctgcgcgtcctgaacctcgtggagaactggctgaacaacaacacccagttctgcatcaaggtgctgaacccctacatgccctccgtcatcgagaagatggaggccctgcagcggaagtacggcggggcgctcgtgcgcaacccgctgagccggaacagcacccacgagatgtactgggtgtccaacgccagcggcaacatcgtctccagcgtgaacatgatctcccgcatgctgatcaaccggttcacgatgcgccacaagaaggccacctacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacgtgggcctaccacggctcctacgagaccaagcagaccgggagcgcctccagcatggtcaacggcgtggtgcggctgctcaccaagccgtgggacgtcctgcccacggtgacccagatggcgatgaccgacaccacgcccttcgggcagcagcgcgtgttcaaggagaaggtcgacacccgcacccaggagcccaaggagggcaccaagaagctgatgaagatcacggccgagtggctctggaaggagctgggcaagaagaagaccccgcggatgtgcacccgcgaggagttcacccggaaggtgcgctccaacgccgccctgggggccatcttcacggacgagaacaagtggaagtccgcgcgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacaccgccgggtgggacacccggatcacgctcgaggacctgaagaacgaggagatggtgaccaaccacatggagggcgagcacaagaagctggcggaggccatcttcaagctcacctaccagaacaaggtcgtgcgcgtgcagcggcccacgccccgggggacggtcatggacatcatcagccggcgcgaccagcggggctccggccaggtggggacctacggcctgaacaccttcaccaacatggaggcccagctgatccgccagatggagggggagggcgtgttcaagaacatccagcacctcacggtcaccgaggaggtggccgtgcagaactggctggcccgggtcgggcgcgagcgcctgagccggatggcgatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagacggcctgcctgggcaagagctacgcccagatgtggtccctgatgtacttccaccggcgcgacctccggctggccgccaacgcgatctgcagcgccgtgccctcccactgggtgccgaccagccgcaccacctggtccatccacgccaagcacgagtggatgaccacggaggacatgctgaccgtctggaaccgggtgtggatccgcgagaacccctggatggaggacaagacccccgtggagagctgggaggagatcccctacctcggcaagcgggaggaccagtggtgcgggtccctgatcggcctgaccagccgcgccacgtgggccaagaacatccaggcggccatcaaccaggtccggtccctcatcgggaacgaggagtacaccgactacatgccgagcatgaagcgcttccggcgcgaggaggaggaggccggcgtgctgtggtga

SEQ ID NO: 9558 - RNA, 9876 nt, synthetic construct
  misc_feature 1..9876: note = derived and/or modified CDS sequence (opt1) from DENV-2__EU482645__SS-prME
  source 1..9876: mol_type = other RNA
agcgccgggatgatcatcatgctgatccccaccgtgatggccttccacctcaccacccggaacggggagccccacatgatcgtcgggatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagaaggtcctcatcttcatcctgctgacggccgtggccccctccatgaccatgcgctgcatcggcatcagcaaccgggacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccgcaagtactgcatcgaggccaagctgaccaacacgaccaccgagagccggtgccccacccagggcgagccctccctgaaggaggagcaggacaagcgcttcgtgtgcaagcacagcatggtggaccggggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccgcaccggcctcgacttcaacgagatggtgctgctgcagatggagaacaaggcctggctcgtgcaccggcagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccgcctgcggatggacaagctccagctgaagggcatgagctactccatgtgcacggggaagttcaaggtggtcaaggagatcgccgagacccagcacggcaccatcgtgatccgcgtgcagtacgagggggacggcagcccctgcaagatccccttcgagatcatggacctggagaagcggtacgtcctcggccgcctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcggggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccgcagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccggtccgtcacgcgcctggagaacctcatgtggaagcagatcacccccgagctgaaccacatcctggccgagaacgaggtgaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggacgggcgtgacctacctggccctgctcgcggccttcaaggtgcggcccaccttcgccgccggcctgctgctccgcaagctgacctccaaggagctgatgatgacgaccatcgggatcgtcctcctgagccagtccaccatccccgagaccgtgctggagctcacggacgccctggcgctgggcatgatggtgctcaagatcgtccggaacatggagaagtaccagctggccgtgaccatcatgaccatcctgtgcgtcccgaacgccgtgatcctccagaacgcctggaaggtgagctgcaccatcctggccgtcgtgtccgtgagccccctgctcctgacgtccagccagcagaagaccgactggatccccctggcgctcaccatcaaggggctgaaccccaccgccatcttcctgacgaccctctcccgcaccaacaagaagcgcagctggccgctgaacgaggccatcatggccgtcggcatggtgtccatcctggcgagctccctcctgaagaacgacatccccatgaccggccccctggtggccgggggcctcctgacggtctgctacgtgctgaccgggcggagcgccgacctcgagctggagcgcgccaccgacgtgaagtgggaggaccaggccgagatctccggcagcagccccatcctgtccatcaccatcagcgaggacgggtccatgagcatcaagaacgaggaggaggagcagacgctcaccatcctgatccggaccggcctgctcgtcatctccggcctgttcccgatcagcatccccatcaccgcggccgcctggtacctgtgggaggtgaagaagcagcgcgccggggtgctctgggacgtccccagcccgccgcccatgggcaaggccgagctggaggacggggcgtaccggatcaagcagaagggcatcctggggtacagccagatcggcgccggcgtgtacaaggaggggaccttccacacgatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgcggtgcagaccaagcccgggctgttcaagaccaacacgggcaccatcggggccgtgtccctcgacttcagccccggcacctccggcagccccatcatcgacaagaaggggaaggtcgtgggcctgtacgggaacggcgtggtcacccggtccggcgcctacgtgagcgccatcgcccagacggagaagtccatcgaggacaaccccgagatcgaggacgacatcttccgcaagcggcgcctgaccatcatggacctgcaccccggggcgggcaagaccaagcggtacctccccgccatcgtgcgcgaggccatcaagcgggggctgcgcaccctgatcctcgccccgacgcgggtcgtggcggccgagatggaggaggccctgcgcggcctgcccatccggtaccagacccccgccatccgcgccgagcacaccgggcgggagatcgtggacctcatgtgccacgcgaccttcacgatgcgcctgctgagccccgtccgcgtgccgaactacaacctcatcatcatggacgaggcccacttcaccgaccccgcctccatcgccgcccggggctacatcagcacccgcgtggagatgggcgaggcggccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagaccgtgtggttcgtgccgagcatcaaggccgggaacgacatcgcggcctgcctgcgcaagaacggcaagaaggtcatccagctgtcccggaagaccttcgacagcgagtacgtgaagacgcgcaccaacgactgggacttcgtggtcaccaccgacatctccgagatgggcgccaacttcaaggccgagcgggtgatcgacccccgccggtgcatgaagcccgtgatcctcacggacggggaggagcgcgtcatcctggcgggccccatgccggtgacccacagctccgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgcgatcgacggcgagtaccgcctgcgcggggaggcccgcaagaccttcgtcgacctcatgcgccggggcgacctgcccgtgtggctggcctacaaggtggccgccgaggggatcaactacgcggaccgccggtggtgcttcgacggcatcaagaacaaccagatcctcgaggagaacgtcgaggtggagatctggacgaaggagggggagcgcaagaagctgaagccgcggtggctggacgcccgcatctactccgaccccctcgccctgaaggagttcaaggagttcgccgccggccggaagtccctgaccctcaacctgatcaccgagatgggccgcctgcccaccttcatgacgcagaagacccgggacgcgctcgacaacctggccgtcctgcacaccgccgaggccgggggccgcgcgtacaaccacgccctctccgagctgcccgagaccctggagacgctcctgctgctcaccctgctggccaccgtgaccgggggcatcttcctcttcctgatgagcggccgggggatcggcaagatgaccctggggatgtgctgcatcatcacggcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgaccgtggtcgccgccacgatggcgaacgagatgggcttcctggagaagaccaagaaggacctcgggctgggctccatcgccacccagcagccggagagcaacatcctggacatcgacctccggcccgcctccgcctggaccctgtacgccgtggcgacgaccttcgtgacccccatgctgcgccacagcatcgagaacagctccgtcaacgtgagcctcaccgccatcgccaaccaggccacggtgctgatgggcctggggaagggctggcccctctccaagatggacatcggggtcccgctgctggccatcggctgctacagccaggtgaaccccatcaccctcaccgcggccctgctgctcctggtggcccactacgccatcatcgggcccggcctgcaggcgaaggccacccgggaggcccagaagcgcgccgccgcgggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaacccggggcgcttctggaacacgaccatcgccgtgagcatggcgaacatcttccggggctcctacctggccggcgccgggctcctcttcagcatcatgaagaacaccaccaacacgcgccggggcaccgggaacatgggcgagaccctgggcgagaagtggaagtcccgcctgaacgccctcggcaagagcgagttccagatctacaagaagtccggcatccaggaggtcgaccgcaccctggccaaggaggggatcaagcggggcgagacggaccaccacgcggtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacacgctgctctgcgacatcggggagtccagccccaacccgaccgtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcacgatgcggcacaagaaggccacctacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacgtgggcctaccacggctcctacgagaccaagcagaccgggagcgcctccagcatggtcaacggcgtggtgcgcctgctcaccaagccgtgggacgtcctgcccacggtgacccagatggcgatgaccgacaccacgcccttcgggcagcagcgggtgttcaaggagaaggtcgacacccgcacccaggagcccaaggagggcaccaagaagctgatgaagatcacggccgagtggctctggaaggagctgggcaagaagaagaccccgcgcatgtgcacccgggaggagttcacccgcaaggtgcggtccaacgccgccctgggggccatcttcacggacgagaacaagtggaagtccgcgcgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgccgggtgggacacccgcatcacgctcgaggacctgaagaacgaggagatggtgaccaaccacatggagggcgagcacaagaagctggcggaggccatcttcaagctcacctaccagaacaaggtcgtgcgggtgcagcgccccacgccccgggggacggtcatggacatcatcagccgccgggaccagcgcggctccggccaggtgggcacctacggcctgaacaccttcaccaacatggaggcccagctgatccggcagatggagggggagggcgtgttcaagaacatccagcacctcacggtcaccgaggaggtggccgtgcagaactggctggcccgcgtcgggcgggagcgcctgagccgcatggcgatctccggcgacgactgcgtggtgaagcccctcgacgaccggttcgccaacgccctgaccgccctgaacgacatgggcaagatccgcaaggacatccagcagtgggagccgagcaaggggtggaacgactggacccaggtccccttctgctcccaccacttccacgagctcatcatgaaggacggccgggtgctggtggtcccctgccgcaaccaggacgagctgatcgggcgggcccgcatcagccagggcgcggggtggtccctccgggagacggcctgcctgggcaagagctacgcccagatgtggtccctgatgtacttccaccgccgggacctccgcctggccgccaacgcgatctgcagcgccgtgccctcccactgggtgccgaccagccggaccacctggtccatccacgccaagcacgagtggatgaccacggaggacatgctgaccgtctggaaccgcgtgtggatccgggagaacccctggatggaggacaagacccccgtggagagctgggaggagatcccctacctcggcaagcgcgaggaccagtggtgcgggtccctgatcggcctgaccagccgggccacgtgggccaagaacatccaggcggccatcaaccaggtccgctccctcatcgggaacgaggagtacaccgactacatgccgagcatgaagcggttccgccgggaggaggaggaggccggcgtgctgtggtga

SEQ ID NO: 9559 - RNA, 9876 nt, synthetic construct
  misc_feature 1..9876: note = derived and/or modified CDS sequence (opt1) from DENV-2__EU482646__SS-prME
  source 1..9876: mol_type = other RNA
agcgcggggatgatcatcatgctgatccccaccgtgatggccttccacctcaccacccggaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcatctgcaagcacagcatggtggaccgcggctgggggaacggctgcggcctgttcggcaagggcgggatcgtgacgtgcgccatgttcacgtgcaagaagaacatggagggcaagatcgtccagcccgagaacctggagtacaccatcgtggtgacgccccactccggggaggagcacgcggtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcaggagtccaactggatccagaaggagaccctggtgaccttcaagaacccccacgccaagaagcaggacgtcgtggtcctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcgtgaccctgatcaccggcaacatgagcttcaaggacctcgggcgggtggtcgtgatggtgggcgccaccatggccgacgacatcgggatgggcgtcacgtacctggccctgctcgcggccttcaaggtgcgccccaccttcgccgccggcctgctgctccggaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtctccatcctggccagctccctcctgaagaacgacatccccatgaccggccccctggtggccgggggcctcctgaccgtgtgctacgtcctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtcaagaagcagcgggccggggtgctctgggacgtgcccagcccgccgcccatgggcaaggcggagctggaggacggggcctaccgcatcaagcagaagggcatcctggggtacagccagatcggcgccggcgtctacaaggaggggaccttccacaccatgtggcacgtgacccggggcgccgtgctcatgcacaaggggaagcgcatcgagccctcctgggccgacgtcaagaaggacctgatcagctacggcgggggctggaagctggagggcgagtggaaggagggggaggaggtccaggtgctcgcgctggagcccggcaagaacccccgggccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccgctccggcgcctacgtcagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtggtcgccgccgagatggaggaggccctgcggggcctgcccatccgctaccagacccccgccatccgggcggagcacacggggcgcgagatcgtggacctcatgtgccacgccaccttcaccatgcgcctgctgagccccgtgcgggtcccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtctggttcgtgccgagcatcaaggcggggaacgacatcgccgcctgcctgcggaagaacggcaagaaggtgatccagctgtcccgcaagaccttcgacagcgagtacgtcaagacccggaccaacgactgggacttcgtggtgacgaccgacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtcaccgggggcatcttcctcttcctgatgagcggccgcgggatcggcaagatgaccctggggatgtgctgcatcaccaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgaccgtggtggccgcgaccatggccaacgagatgggcttcctggagaagacgaagaaggacctcgggctgggctccatcgccacccagcagccggagagcaacatcctggacatcgacctccgccccgcctccgcctggaccctgtacgcggtcgccaccacgttcgtgacccccatgctgcggcacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcacgctcaccgccgccctgctgctcctggtggcccactacgcgatcatcgggcccggcctgcaggccaaggccacccgcgaggcccagaagcgggccgcggccggcatcatgaagaaccccaccgtggacgggatcacggtcatcgacctcgacccgatcccctacgaccccaagttcgagaagcagctgggccaggtgatgctgctcatcctgtgcgtgacccaggtcctgatgatgcgcaccacctgggccctctgcgaggccctgacgctggccaccgggcccatctccaccctctgggagggcaacccggggcggttctggaacaccacgatcgcggtgagcatggccaacatcttccgcggctcctacctggccggcgccgggctcctcttcagcatcatgaagaacaccaccaacacccggcgcggcacggggaacatgggcgagaccctgggcgagaagtggaagtcccgcctgaacgccctcgggaagtccgagttccagatctacaagcggtccggcatccaggaggtggaccgcaccctggcgaaggaggggatcaagcggggcgagaccgaccaccacgccgtcagccgcgggtccgccaagctgcggtggttcgtggagcgcaacatggtgacgcccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacctacgggtggaacctcgtgcggctgcagagcggcgtggacgtcttcttcatcccgcccgagaagtgcgacaccctgctctgcgacatcggggagtccagccccaacccgacggtggaggccggccgcaccctgcgggtgctgaacctcgtcgagaactggctgaacaacaacacccagttctgcatcaaggtgctgaacccctacatgccctccgtgatcgagaagatggaggcgctgcagcgcaagtacggcggggccctcgtccggaacccgctgagccgcaacagcacccacgagatgtactgggtgtccaacgccagcggcaacatcgtgtccagcgtcaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtgaacggcgtcgtgcgcctgctcaccaagccgtgggacgtgctgcccaccgtcacgcagatggccatgaccgacaccacccccttcgggcagcagcgcgtgttcaaggagaaggtggacacgcggacccaggagcccaaggagggcaccaagaagctgatgaagatcaccgccgagtggctctggaaggagctgggcaagaagaagacgccgcgcatgtgcacccgggaggagttcacccgcaaggtccggtccaacgccgccctgggggcgatcttcaccgacgagaacaagtggaagtccgcccgcgaggccgtggaggactcccggttctgggagctcgtggacaaggagcgcaacctgcacctggagggcaagtgcgagacgtgcgtctacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgccatgtacgccgacgacaccgcggggtgggacacccgcatcaccctcgaggacctgaagaacgaggagatggtgacgaaccacatggagggcgagcacaagaagctggccgaggccatcttcaagctcacctaccagaacaaggtggtccgggtgcagcgccccacgccccgggggaccgtgatggacatcatcagccgccgggaccagcgcggctccgggcaggtcggcacgtacggcctgaacaccttcaccaacatggaggcccagctgatccggcagatggagggggagggcgtgttcaagaacatccagcacctcaccgtgacggaggaggtcgccgtgcagaactggctggcgcgcgtggggcgcgagcggctgagccgcatggccatctccggcgacgactgcgtcgtgaagcccctcgacgaccggttcgccaacgccctgaccgccctgaacgacatgggcaagatccgcaaggacatccagcagtgggagccgagcaaggggtggaacgactggacccaggtgcccttctgctcccaccacttccacgagctcatcatgaaggacggccgggtcctggtggtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtcccctcccactgggtgccgacgagccggaccacctggtccatccacgccaagcacgagtggatgaccaccgaggacatgctgacggtgtggaaccgcgtctggatccgggagaacccctggatggaggacaagacccccgtggagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacacggactacatgccgagcatgaagcggttccgccgcgaggaggaggaggccggcgtcctgtggtga

SEQ ID NO: 9560 - RNA, 9876 nt, synthetic construct
  misc_feature 1..9876: note = derived and/or modified CDS sequence (opt1) from DENV-2__EU482647__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatgaagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagacctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacgcccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgacggtggaggccggccggaccctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacgtacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcgtccagcatggtcaacggcgtggtgcggctgctcaccaagccgtgggacgtcctgcccaccgtgacgcagatggccatgaccgacaccacccccttcgggcagcagcgcgtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacaccgcggggtgggacacccggatcaccctcgaggacctgaagaacgaggagatggtgacgaaccacatggagggcgagcacaagaagctggccgaggccatcttcaagctcacctaccagaacaaggtcgtgcgcgtgcagcggcccacgccccgggggaccgtcatggacatcatcagccggcgcgaccagcggggctccggccaggtggggacgtacggcctgaacaccttcaccaacatggaggcccagctgatccgccagatggagggggagggcgtgttcaagaacatccagcacctcaccgtcacggaggaggtggccgtgcagaactggctggcgcgggtcgggcgcgagcgcctgagccggatggccatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacacggactacatgccgagcatgaagcgcttccggcgcgaggaggaggaggccggcgtgctgtggtga

SEQ ID NO: 9561 - RNA, 9876 nt, synthetic construct
  misc_feature 1..9876: note = derived and/or modified CDS sequence (opt1) from DENV-2__EU482648__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacacgatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacgtggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgcggagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtgttcggggccatctacggcgccgccttcagcggggtctcctggaccatgaagatcctgatcggcgcgatcatcacgtggatcgggatgaacagccgctccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccgcccgggctactacacccagacggccgggccctggcacctcggcaagctggagatggacttcgacttctgcgaggggaccaccgtcgtggtgaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtcaactccctggtgaccgcggggcacggccagatcgacaacttcagcctcggcgtgctggggatggccctgttcctcgaggagatgctgcggacccgcgtcggcaccaagcacgccatcctgctcgtggccgtgtccttcatgacgctgatcaccgggaacatgagcttccgggacctgggccgcgtcatggtgatggtgggggccaccatgaccgacgacatcggcatgggcgtcacgtacctcgcgctgctggccgccttcaaggtgcgccccaccttcgccgccgggctcctgctgcggaagctcacctccaaggagctgatgatggcgaccatcggcatcgccctgctcagccagtccacgatccccgagaccatcctggagctgaccgacgccctcgccctggggatgatggtgctgaagatcgtccgcaacatggagaagtaccagctcgccgtgaccatcatggcgatcagctgcgtgccgaacgccgtcatcctgcagaacgcctggaaggtgtcctgcacgatcctggccgcggtgagcgtcagccccctcctgctgaccagctcccagcagaaggccgactggatccccctcgccctgaccatcaagggcctgaaccccaccgccatcttcctcacgaccctgagccggacctccaagaagcgcagctggccgctgaacgaggccatcatggcggtgggcatggtgtccatcctcgccagcagcctgctgaagaacgacatccccatgaccgggcccctcgtcgccggcgggctgctgacggtgtgctacgtcctcaccggccggtccgccgacctggagctggagcgcgccaccgacgtgaagtgggaggaccaggcggagatcagcgggtccagccccatcctctccatcaccatcagcgaggacggctccatgagcatcaagaacgaggaggaggagcagacgctgaccatcctgatccggaccggcctcctggtgatctccgggctgttcccggtcagcatccccatcaccgccgccgcctggtacctctgggaggtgaagaagcagcgcgccggcgtgctgtgggacgtccccagcccgccgcccgtggggaaggcggagctggaggacggcgcctaccggatcaagcagaaggggatcctcggctacagccagatcggcgccggggtgtacaaggagggcaccttccacacgatgtggcacgtcacccgcggggccgtgctgatgcaccggggcaagcgcatcgagccctcctgggccgacgtgaagaaggacctgatcagctacgggggcggctggaagctcgagggggagtggaaggagggcgaggaggtccaggtgctggcgctggagcccgggaagaacccccgggccgtgcagaccaagcccggcctcttcaagaccaacacggggaccatcggcgccgtctccctggacttcagccccggcacctccgggagccccatcgtggaccgcaagggcaaggtggtcgggctgtacggcaacggcgtggtgacccggtccggggcctacgtcagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcggaccctcatcctggcgccgacgcgcgtggtcgccgccgagatggaggaggccctgcgcgggctccccatccggtaccagacccccgccatccgcgcggagcacaccggccgggagatcgtggacctgatgtgccacgccaccttcacgatgcgcctgctctcccccgtgcgggtcccgaactacaacctgatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagtccaacgcgcccatcatcgacgaggagcgggagatccccgagcgcagctggaactccggccacgagtgggtgaccgacttcaaggggaagaccgtctggttcgtgccgagcatcaaggccggcaacgacatcgccgcctgcctgcggaagaacggcaagaaggtgatccagctctcccgcaagaccttcgacagcgagtacgtcaagacgcggaccaacgactgggacttcgtggtgaccaccgacatctccgagatgggggccaacttcaaggcggagcgcgtcatcgacccccggcgctgcatgaagcccgtgatcctgacggacggcgaggagcgggtgatcctggccgggcccatgccggtcacccacagctccgccgcccagcgccggggccgcatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagaccttcgtggacctgatgcggcgcggggacctgcccgtctggctcgcctaccgggtggccgcggagggcatcaactacgccgaccgccggtggtgcttcgacggggtgaagaacaaccagatcctggaggagaacgtcgaggtggagatctggacgaaggagggcgagcgcaagaagctgaagccgcggtggctcgacgcccgcatctactccgaccccctggccctgaaggagttcaaggagttcgcggccggccggaagtccctcaccctgaacctgatcaccgagatggggcgcctccccaccttcatgacgcagaaggcccgggacgccctggacaacctggccgtgctccacaccgcggaggccggcgggcgcgcctacaaccacgccctgtccgagctgcccgagaccctcgagaccctgctgctcctgacgctgctcgccaccgtcaccggcggcatcttcctgttcctgatgagcgggaagggcgtggggaagatgaccctcggcatgtgctgcatcatcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtcgtgatcgccatcctgaccgtcgtggcggccaccatggccaacgagatggggttcctcgagaagacgaagaaggacctgggcctgggcagcatcgccacccaggagccggagtccaacatcctcgacatcgacctgcgccccgccagcgcgtggaccctgtacgccgtggccaccacgttcgtcacccccatgctccggcactccatcgagaacagctccgtgaacgtgagcctgaccgccatcgcgaaccaggccaccgtcctgatggggctcggcaaggggtggcccctgtccaagatggacatcggcgtgccgctgctcgccatcgggtgctacagccaggtgaaccccatcacgctgaccgccgccctgctcctgctgatcgcgcactacgccatcatcggccccggcctccaggccaaggccacccgcgaggcccagaagcgggcggccgccgggatcatgaagaaccccaccgtcgacggcatcacggtgatcgacctggacccgatcccctacgaccccaagttcgagaagcagctgggccaggtgatgctcctgatcctgtgcgtcacccaggtgctcatgatgcgcaccacctgggccctgtgcgaggccctgacgctcgcgaccggccccatctccaccctgtgggaggggaacccgggccgcttctggaacaccacgatcgccgtgagcatggccaacatcttccggggctcctacctggccggggcgggcctcctgttcagcatcatgaagaacaccaccaacacccgccgggggacgggcaacatcggcgagaccctgggggagaagtggaagtcccgcctcaacgccctgggcaagagcgagttccagatctacaagaagtccgggatccaggaggtcgaccggaccctggccaaggagggcatcaagcgcggggagaccgaccaccacgccgtgagccggggctccgccaagctccgctggttcgtggagcggaacatggtcacgcccgagggcaaggtggtggacctggggtgcggccgcgggggctggagctactactgcgggggcctgaagaacgtccgggaggtgaagggcctcaccaagggcggccccgggcacgaggagcccatcccgatgtccacctacggctggaacctggtgcgcctgcagagcggggtcgacgtgttcttcacgccgcccgagaagtgcgacacgctcctgtgcgacatcggcgagagctcccccaacccgaccatcgaggcgggccggaccctgcgcgtgctcagcctggtcgagaactggctgaacaacgacacccagttctgcatcaaggtgctcaacccctacatgccctccgtgatcgagaagatggagaccctgcagcggaagtacgggggcgccctggtccgcaacccgctgagccggaactccacgcacgagatgtactgggtgagcaacgccaccgggaacatcgtgtccagcgtcaacatgatctcccgcatgctcatcaaccggttcaccatgaagcacaagaaggccacctacgagcccgacgtggacctgggcagcgggacgcgcaacatcggcatcgagtccgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcgtccagcatggtgaacggggtcgtgcggctcctgaccaagccgtgggacgtggtccccatggtgacccagatggccatgaccgacacgacccccttcggccagcagcgcgtgttcaaggagaaggtcgacacccggacccaggagcccaaggagggcacgaagaagctgatgaagatcaccgccgagtggctctggaaggagctggggaagaagaagaccccgcgcatgtgcacccgggaggagttcacgcgcaaggtgcggtccaacgccgccctgggcgcgatcttcaccgacgagaacaagtggaagtccgcccgcgaggccgtggaggactcccggttctgggagctcgtcgacaaggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttcagccgcgagaactccctgagcggggtggagggcgaggggctccacaagctgggctacatcctgcgggacgtctccaagaaggagggcggggccatgtacgccgacgacaccgcgggctgggacacgcgcatcaccctcgaggacctgaagaacgaggagatggtgaccaaccacatggagggggagcacaagcggctggccgaggccatcttcaagctcacctaccagaacaaggtggtccgcgtgcagcggcccacgccccgcggcaccgtcatggacatcatcagccggcgcgaccagcgcgggtccggccaggtgggcacctacgggctgaacaccttcacgaacatggaggcccagctgatccggcagatggagggcgaggggatcttcaagagcatccagcacctcaccgtgaccgaggagatcgccgtccagaactggctggcgcgcgtgggccgggagcgcctgtcccggatggccatcagcggcgacgactgcgtggtcaagcccctcgacgaccgcttcgcctccgccctgaccgccctgaacgacatggggaaggtgcggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcgcggatcagccagggggccggctggtccctcaaggagaccgcctgcctgggcaagagctacgcccagatgtggtccctgatgtacttccaccgccgggacctccgcctggccgcgaacgccatctgcagcgccgtcccctcccactgggtgccgaccagccggaccacctggagcatccacgccaagcacgagtggatgacgaccgaggacatgctgaccgtgtggaaccgcgtctggatccaggagaacccctggatggaggacaagacccccgtggagtcctgggaggaggtgccctacctcgggaagcgggaggaccagtggtgcggcagcctgatcgggctgacgtcccgcgcgacctgggccaagaacatccagaccgccatcaaccaggtccggagcctcatcggcaacgaggagtacaccgactacatgccgtccatgaagcgcttccgccgggaggaggaggaggccggggtgctgtggtga

SEQ ID NO: 9562 - RNA, 9876 nt, synthetic construct
  misc_feature 1..9876: note = derived and/or modified CDS sequence (opt1) from DENV-2__EU482649__SS-prME
  source 1..9876: mol_type = other RNA
agcgcgggcatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacgcggaccgagacctggatgagcagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccatcgccccctccatgaccatgcggtgcatcggcatcagcaaccgcgacttcgtggagggcgtgtccgggggcagctgggtcgacatcgtgctcgagcacgggtcctgcgtgaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcggcctgttcggcaagggcgggatcgtgacgtgcgccatgttcacgtgcaagaagaacatggagggcaagatcgtccagcccgagaacctggagtacaccatcgtggtgacgccccactccggggaggagcacgcggtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcaggagtccaactggatccagaaggagaccctggtgaccttcaagaacccccacgccaagaagcaggacgtcgtggtcctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcgtgaccctgatcaccggcaacatgagcttcaaggacctcgggcgggtggtcgtgatggtgggcgccaccatggccgacgacatcgggatgggcgtctcctacctggccctgctcgcggccttcaaggtgcgccccacgttcgccgccggcctgctgctccggaagctgaccagcaaggagctgatgatgaccaccatcgggatcgtgctcctgtcccagagcacgatccccgagaccgtcctggagctcaccgacgccctggcgctgggcatgatggtgctcaagatcgtgcgcaacatggagaagtaccagctggccgtcaccatcatggccatcctgtgcgtgccgaacgccgtcgtgctccagaacgcctggaaggtgtcctgcacgatcctggcggtcgtgagcgtgagccccctgctcctgaccagctcccagcagaagaccgactggatccccctggccctcaccatcaaggggctgaaccccacggccatcttcctgaccaccctcagccgcaccaacaagaagcggtcctggccgctgaacgaggccatcatggcggtcggcatggtgagcatcctggcctccagcctcctgaagaacgacatccccatgacgggccccctggtggccgggggcctcctgaccgtctgctacgtgctgaccgggcgctccgccgacctcgagctggagcgggccaccgacgtgaagtgggaggaccaggcggagatcagcggcagctcccccatcctgagcatcacgatctccgaggacgggagcatgtccatcaagaacgaggaggaggagcagaccctcaccatcctgatccgcaccggcctgctcgtcatcagcggcctgttcccgatctccatccccatcacggccgccgcctggtacctgtgggaggtgaagaagcagcgggccggggtgctctgggacgtcccctccccgccgcccatgggcaaggcggagctggaggacggggcctaccgcatcaagcagaagggcatcctggggtactcccagatcggcgccggcgtgtacaaggaggggaccttccacaccatgtggcacgtgacccggggcgccgtcctcatgcacaaggggaagcgcatcgagcccagctgggccgacgtgaagaaggacctgatctcctacggcgggggctggaagctggagggcgagtggaaggagggggaggaggtgcaggtcctcgcgctggagcccggcaagaacccccgggccgtgcagaccaagcccgggctgttcaagacgaacaccggcaccatcggggccgtgagcctcgacttctcccccggcaccagcggctcccccatcatcgacaagaaggggaaggtcgtgggcctgtacgggaacggcgtggtcacgcgcagcggcgcctacgtgtccgccatcgcgcagaccgagaagtccatcgaggacaaccccgagatcgaggacgacatcttccggaagcgccggctgaccatcatggacctgcaccccggggccggcaagaccaagcgctacctccccgccatcgtgcgggaggccatcaagcgcgggctgcggacgctgatcctcgcgccgacccgcgtcgtggccgccgagatggaggaggccctgcggggcctgcccatccgctaccagacccccgccatcaaggcggagcacaccgggcgggagatcgtggacctcatgtgccacgccacgttcaccatgcgcctgctgtcccccgtccgcgtgccgaactacaacctcatcatcatggacgaggcccacttcaccgaccccgccagcatcgccgcgcggggctacatcagcacccgcgtggagatgggcgaggccgccgggatcttcatgacggccacgccgcccggctcccgggacccgttcccccagagcaacgcccccatcatcgacgaggagcgcgagatccccgagcggtcctggaacagcgggcacgagtgggtcaccgacttcaagggcaagaccgtgtggttcgtgccgtccatcaaggcggggaacgacatcgccgcctgcctgcgcaagaacggcaagaaggtcatccagctgagccggaagacgttcgactccgagtacgtgaagacccgcaccaacgactgggacttcgtggtcaccacggacatcagcgagatgggcgccaacttcaaggcggagcgggtgatcgacccccgccggtgcatgaagcccgtgatcctcaccgacggggaggagcgcgtcatcctggccggccccatgccggtgacccactccagcgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtggacgccatcgacggcgagtaccgcctgcgcggggaggcccgcaagacgttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccacgttcatgacccagaagacccgggacgccctcgacaacctggccgtcctgcacaccgccgaggccggcgggcgcgcctacaaccacgccctcagcgagctgcccgagacgctggagaccctcctgctgctcaccctgctggccaccgtgaccggcgggatcttcctcttcctgatgtccgggcgggggatcgggaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacctacgtcgtgatcgccatcctgacggtggtcgccgcgaccatggccaacgagatgggcttcctggagaagaccaagaaggacctcgggctgggcagcatcgccacccagcagccggagtccaacatcctggacatcgacctccggcccgccagcgcctggacgctgtacgcggtggccaccaccttcgtgacccccatgctgcgccacagcatcgagaactccagcgtcaacgtgtccctcacggccatcgccaaccaggccaccgtgctgatgggcctggggaagggctggcccctcagcaagatggacatcggggtcccgctgctggcgatcggctgctactcccaggtgaaccccatcaccctcaccgccgccctgctgctcctggtggcccactacgcgatcatcgggcccggcctgcaggccaaggccacgcgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggacgacctgggccctctgcgaggccctgaccctggccaccgggcccatcagcacgctctgggagggcaacccggggcgcttctggaacaccaccatcgcggtgtccatggccaacatcttccggggcagctacctggccggcgccgggctcctcttctccatcatgaagaacaccacgaacacccgccggggcaccgggaacatcggcgagaccctgggcgagaagtggaagtcccgcctgaacgccctcgggaagtccgagttccagatctacaagaagtccggcatccaggaggtcgaccgcacgctggcgaaggaggggatcaagcggggcgagaccgaccaccacgccgtgtcccgcgggagcgccaagctgcggtggttcgtggagcgcaacatggtcacccccgagggcaaggtggtggacctcggctgcgggcggggcgggtggtcctactactgcggcgggctgaagaacgtccgcgaggtgaagggcctgaccaagggcgggcccggccacgaggagcccatcccgatgagcacgtacgggtggaacctcgtgcggctgcagtccggcgtcgacgtgttcttcatcccgcccgagaagtgcgacaccctgctctgcgacatcggggagagctcccccaacccgaccgtggaggccggccgcaccctgcgggtcctgaacctcgtggagaactggctgaacaacaacacgcagttctgcatcaaggtgctgaacccctacatgcccagcgtcatcgagaagatggaggcgctgcagcgcaagtacggcggggccctcgtgcggaacccgctgagccgcaactccacccacgagatgtactgggtgagcaacgcctccggcaacatcgtcagctccgtgaacatgatcagccggatgctgatcaaccgcttcaccatgcggcacaagaaggccacctacgagcccgacgtggacctcgggtccggcacccgcaacatcgggatcgagagcgagatccccaacctggacatcatcggcaagcggatcgagaagatcaagcaggagcacgagacgtcctggcactacgaccaggaccacccctacaagacctgggcctaccacggcagctacgagaccaagcagaccgggtccgcgagctccatggtcaacggcgtggtgcgcctgctcacgaagccgtgggacgtcctgcccaccgtgacccagatggccatgaccgacacgacccccttcgggcagcagcgggtgttcaaggagaaggtcgacacccgcacccaggagcccaaggagggcacgaagaagctgatgaagatcaccgccgagtggctctggaaggagctgggcaagaagaagaccccgcgcatgtgcacccgggaggagttcacgcgcaaggtgcggagcaacgccgccctgggggcgatcttcaccgacgagaacaagtggaagtccgcccgcgaggccgtggaggacagccggttctgggagctcgtcgacaaggagcgcaacctgcacctggagggcaagtgcgagacctgcgtgtacaacatgatggggaagcgggagaagaagctcggcgagttcgggaaggccaagggctcccgcgccatctggtacatgtggctgggcgcgcggttcctggagttcgaggccctcgggttcctgaacgaggaccactggttcagccgcgagaactccctgagcggcgtcgagggggagggcctccacaagctggggtacatcctgcgggacgtgagcaagaaggagggcggcgccatgtacgccgacgacaccgcggggtgggacacgcgcatcaccctcgaggacctgaagaacgaggagatggtgaccaaccacatggagggcgagcacaagaagctggccgaggccatcttcaagctcacctaccagaacaaggtcgtgcgggtgcagcgccccacgccccgggggaccgtcatggacatcatctcccgccgggaccagcgcggcagcggccaggtggggacctacggcctgaacaccttcacgaacatggaggcccagctgatccggcagatggagggggagggcgtgttcaagaacatccagaacctcaccgtcaccgaggaggtggccgtgcagaactggctggcgcgcgtcgggcgggagcgcctgtcccgcatggccatcagcggcgacgactgcgtggtgaagcccctcgacgaccggttcgccaacgccctgaccgccctgaacgacatgggcaagatccgcaaggacatccagcagtgggagccgtccaaggggtggaacgactggacgcaggtccccttctgcagccaccacttccacgagctcatcatgaaggacggccgggtgctggtggtcccctgccgcaaccaggacgagctgatcgggcgggcgcgcatctcccagggcgccgggtggagcctccgggagaccgcctgcctgggcaagtcctacgcccagatgtggagcctgatgtacttccaccgccgggacctccgcctggccgcgaacgccatctgctccgccgtgcccagccactgggtgccgacctcccggaccacgtggagcatccacgccaagcacgagtggatgaccaccgaggacatgctgaccgtctggaaccgcgtgtggatccgggagaacccctggatggaggacaagacccccgtggagtcctgggaggagatcccctacctcggcaagcgcgaggaccagtggtgcgggagcctgatcggcctgacgtcccgggccacctgggcgaagaacatccaggccgccatcaaccaggtccgcagcctcatcgggaacgaggagtacaccgactacatgccgagcatgaagcggttccgccgggaggaggaggaggccggcgtgctgtggtga

SEQ ID NO: 9563 - RNA, 9876 nt, synthetic construct
  misc_feature 1..9876: note = derived and/or modified CDS sequence (opt1) from DENV-2__EU482650__SS-prME
  source 1..9876: mol_type = other RNA
agcgcgggcatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggaagttctggaacaccaccatcgcggtgagcatggccaacatcttccggggctcctacctggccggcgccgggctcctcttcagcatcatgaagaacacgaccaacacccgccggggcaccgggaacatgggcgagacgctgggcgagaagtggaagtcccgcctgaacaccctcgggaagtccgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacgcccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgacggtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctgctcaccaagccgtgggacgtcctgcccaccgtgacgcagatggcgatgaccgacaccacccccttcgggcagcagcgggtgttcaaggagaaggtcgacacgcgcacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggccatcttcaccgacgagaacaagtggaagtccgcgcgcgaggccgtggaggactcccggttctgggagctcgtcgacaaggagcgcaacctgcacctggagggcaagtgcgagacgtgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgccgggtgggacacccgcatcaccctcgaggacctgaagaacgaggagatggtgacgaaccacatggagggcgagcacaagaagctggcggaggccatcttcaagctcacctaccagaacaaggtcgtgcgggtgcagcgccccacgccccgggggaccgtcatggacatcatcagccgccgggaccagcgcggctccggccaggtggggacgtacggcctgaacaccttcaccaacatggaggcccagctgatccggcagatggagggggagggcgtgttcaagaacatccagcacctcaccgtcacggaggaggtggccgtgcagaactggctggcccgcgtcgggcgggagcgcctgagccgcatggcgatctccggcgacgactgcgtggtgaagcccctcgacgaccggttcgccaacgccctgaccgccctgaacgacatgggcaagatccgcaaggacatccagcagtgggagccgagcaaggggtggaacgactggacccaggtccccttctgctcccaccacttccacgagctcatcatgaaggacggccgggtgctggtggtcccctgccgcaaccaggacgagctgatcgggcgggcccgcatcagccagggcgcggggtggtccctccgggagaccgcctgcctgggcaagagctacgcccagatgtggtccctgatgtacttccaccgccgggacctccgcctggccgccaacgcgatctgcagcgccgtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctcggcaagcgcgaggaccagtggtgcgggtccctgatcggcctgaccagccgggccacctgggccaagaacatccaggcggccatcaaccaggtccgctccctcatcgggaacgaggagtacacggactacatgccgagcatgaagcggttccgccgggaggaggaggaggccggcgtgctgtggtga

SEQ ID NO: 9564 - RNA, 9876 nt, synthetic construct
  misc_feature 1..9876: note = derived and/or modified CDS sequence (opt1) from DENV-2__EU482651__SS-prME
  source 1..9876: mol_type = other RNA
agcgcggggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctccggctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcaccggcccctggcacctggggaagctggagatggacttcgacttctgcgacggcaccacggtgatcgtcaccgaggactgcgggaaccgcggcccctccctccggaccaccacggcgagcggcaagctgatcaccgagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacgcgggtggggaccaagcacgccatcctcctggtcaccgtgtccttcgtgaccctgatcacgggcaacatgagcttcaaggacctcgggcgcgtcgtggtgatggtcggcgcgaccatggccgacgacatcgggatgggcgtgacctacctggccctgctcgccgccttcaaggtgcggcccaccttcgcggccggcctgctgctccgcaagctgacgtccaaggagctgatgatgaccaccatcgggatcgtcctcctgagccagtccaccatccccgagacggtgctggagctcaccgacgccctggccctgggcatgatggtgctcaagatcgtccgcaacatggagaagtaccagctggccgtgaccatcatggcgatcctgtgcgtcccgaacgccgtggtgctccagaacgcctggaaggtcagctgcaccatcctggccgtggtgtccgtcagccccctgctcctgacgtccagccagcagaagaccgactggatccccctggccctcaccatcaaggggctgaaccccaccgcgatcttcctgacgaccctctcccggaccaacaagaagcgcagctggccgctgaacgaggccatcatggccgtgggcatggtgtccatcctggccagctccctcctgaagaacgacatccccatgaccggccccctggtcgccggcgggctcctgacggtgtgctacgtgctgaccgggcggagcgccgacctcgagctggagcgcgccaccgacgtcaagtgggaggaccaggccgagatctccgggagcagccccatcctgtccatcaccatcagcgaggacgggtccatgagcatcaagaacgaggaggaggagcagacgctcaccatcctgatccggaccggcctgctcgtgatctccggcctgttcccgatcagcatccccatcaccgccgcggcctggtacctgtgggaggtgaagaagcagcgcgccggggtcctctgggacgtgcccagcccgccgcccatgggcaaggccgagctggaggacggggcctaccggatcaagcagaagggcatcctggggtacagccagatcggcgcgggcgtgtacaaggaggggaccttccacacgatgtggcacgtcacccgcggcgccgtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacacgggcaccatcggggcggtctccctcgacttcagccccggcacctccggcagccccatcatcgacaagaaggggaaggtggtgggcctgtacgggaacggcgtcgtgacccggtccggcgcctacgtgagcgccatcgcccagacggagaagtccatcgaggacaaccccgagatcgaggacgacatcttccgcaagcggcgcctgaccatcatggacctgcaccccggggccggcaagaccaagcggtacctccccgcgatcgtccgcgaggccatcaagcgggggctgcgcaccctgatcctcgccccgacgcgggtggtggccgcggagatggaggaggccctgcgcggcctgcccatccggtaccagacccccgccatcaaggccgagcacaccgggcgcgagatcgtcgacctcatgtgccacgccaccttcacgatgcgcctgctgagccccgtgcgggtgccgaactacaacctcatcatcatggacgaggcgcacttcaccgaccccgcctccatcgccgcccgcggctacatcagcacccgggtcgagatgggcgaggccgcggggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagaccgtgtggttcgtcccgagcatcaaggccgggaacgacatcgccgcgtgcctgcggaagaacggcaagaaggtgatccagctgtcccgcaagaccttcgacagcgagtacgtgaagacgcggaccaacgactgggacttcgtcgtgaccaccgacatctccgagatgggcgccaacttcaaggccgagcgcgtgatcgacccccggcgctgcatgaagcccgtcatcctcacggacggggaggagcgggtgatcctggccggccccatgccggtgacccacagctccgcggcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtcgacgccatcgacggcgagtaccggctgcgcggggaggcgcgcaagaccttcgtggacctcatgcggcgcggcgacctgcccgtgtggctggcctacaaggtcgccgccgaggggatcaactacgccgaccggcgctggtgcttcgacggcatcaagaacaaccagatcctcgaggagaacgtggaggtcgagatctggacgaaggagggggagcggaagaagctgaagccgcgctggctggacgcgcggatctactccgaccccctcgccctgaaggagttcaaggagttcgccgccggccgcaagagcctgaccctcaacctgatcaccgagatgggccggctgcccaccttcatgacgcagaagacccgcgacgccctcgacaacctggcggtgctgcacaccgccgaggccgggggccgggcctacaaccacgcgctctccgagctgcccgagaccctggagacgctcctgctgctcaccctgctggccaccgtgaccgggggcatcttcctcttcctgatgagcggccgcgggatcggcaagatgaccctggggatgtgctgcatcatcacggcctccatcctcctgtggtacgcccagatccagccgcactggatcgccgcgagcatcatcctggagttcttcctcatcgtcctgctgatccccgagcccgagaagcagcggacgccccaggacaaccagctcacctacgtggtgatcgccatcctgaccgtcgtggccgccacgatggccaacgagatgggcttcctggagaagaccaagaaggacctcgggctgggctccatcgcgacccagcagccggagagcaacatcctggacatcgacctccgccccgcctccgcctggaccctgtacgccgtggccacgaccttcgtcacccccatgctgcggcacagcatcgagaacagctccgtgaacgtgagcctcaccgcgatcgccaaccaggccacggtcctgatgggcctggggaagggctggcccctctccaagatggacatcggggtgccgctgctggccatcggctgctacagccaggtgaaccccatcaccctcaccgccgcgctgctgctcctggtcgcccactacgccatcatcgggcccggcctgcaggccaaggcgacccgcgaggcccagaagcgggccgccgccggcatcatgaagaaccccacggtggacgggatcaccgtgatcgacctcgacccgatcccctacgaccccaagttcgagaagcagctgggccaggtcatgctgctcatcctgtgcgtgacccaggtgctgatgatgcgcaccacgtgggcgctctgcgaggccctgaccctggccaccgggcccatctccaccctctgggagggcaacccggggcggttctggaacacgaccatcgccgtcagcatggccaacatcttccgcggctcctacctggcgggcgccgggctcctcttcagcatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtggaccggaccctggccaaggaggggatcaagcgcggcgagacggaccaccacgccgtgagccgggggtccgcgaagctgcgctggttcgtcgagcggaacatggtgacccccgagggcaaggtggtcgacctcggctgcgggcgcggcgggtggagctactactgcggcgggctgaagaacgtgcgggaggtgaagggcctgaccaagggcgggcccggccacgaggagcccatcccgatgtccacctacgggtggaacctcgtccgcctgcagagcggcgtggacgtgttcttcatcccgcccgagaagtgcgacacgctgctctgcgacatcggggagtccagccccaacccgaccgtcgaggccggccggaccctgcgcgtgctgaacctcgtggagaactggctgaacaacaacacccagttctgcatcaaggtcctgaacccctacatgccctccgtgatcgagaagatggaggccctgcagcggaagtacggcggggccctcgtgcgcaacccgctgagccggaacagcacccacgagatgtactgggtctccaacgcgagcggcaacatcgtgtccagcgtgaacatgatctcccgcatgctgatcaaccggttcacgatgcgccacaagaaggccacctacgagcccgacgtcgacctcgggagcggcacccggaacatcgggatcgagtccgagatccccaacctggacatcatcggcaagcgcatcgagaagatcaagcaggagcacgagaccagctggcactacgaccaggaccacccctacaagacgtgggcctaccacggctcctacgagaccaagcagaccgggagcgcctccagcatggtgaacggcgtggtccggctgctcaccaagccgtgggacgtgctgcccacggtgacccagatggccatgaccgacaccacgcccttcgggcagcagcgcgtcttcaaggagaaggtggacacccgcacccaggagcccaaggagggcaccaagaagctgatgaagatcacggcggagtggctctggaaggagctgggcaagaagaagaccccgcggatgtgcacccgcgaggagttcacccggaaggtgcgctccaacgccgccctgggggccatcttcacggacgagaacaagtggaagtccgcccgggaggcggtcgaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcccgcttcctggagttcgaggccctcgggttcctgaacgaggaccactggttctcccgggagaacagcctgtccggcgtggagggggagggcctccacaagctggggtacatcctgcgcgacgtgagcaagaaggagggcggcgcgatgtacgccgacgacaccgccgggtgggacacccggatcacgctcgaggacctgaagaacgaggagatggtcaccaaccacatggagggcgagcacaagaagctggccgaggcgatcttcaagctcacctaccagaacaaggtggtgcgcgtccagcggcccacgccccgcgggacggtgatggacatcatcagccggcgcgaccagcggggctccggccaggtgggcacctacggcctgaacaccttcaccaacatggaggcccagctgatccgccagatggagggggagggcgtcttcaagaacatccagcacctcacggtgaccgaggaggtggccgtccagaactggctggcccgggtggggcgcgagcgcctgagccggatggccatctccggcgacgactgcgtggtcaagcccctcgacgaccgcttcgcgaacgccctgaccgccctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctgatcgggcgcgcccggatcagccagggcgccgggtggtccctccgcgagacggcgtgcctgggcaagagctacgcccagatgtggtccctgatgtacttccaccggcgcgacctccggctggccgccaacgccatctgcagcgcggtgccctcccactgggtcccgaccagccgcaccacctggtccatccacgccaagcacgagtggatgaccacggaggacatgctgaccgtgtggaaccgggtgtggatccgcgagaacccctggatggaggacaagacccccgtcgagagctgggaggagatcccctacctcggcaagcgggaggaccagtggtgcgggtccctgatcggcctgaccagccgcgccacgtgggccaagaacatccaggccgcgatcaaccaggtgcggtccctcatcgggaacgaggagtacaccgactacatgccgagcatgaagcgcttccggcgcgaggaggaggaggccggcgtgctgtggtga

SEQ ID NO: 9565 - RNA, 9876 nt, synthetic construct
  misc_feature 1..9876: note = derived and/or modified CDS sequence (opt1) from DENV-2__EU482652__SS-prME
  source 1..9876: mol_type = other RNA
agcgcggggatgatcatcatgctgatccccaccgtgatggccttccacctcaccacccggaacggggagccgcacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccctgtgcacggggaagttcaaggtggtcaaggagatcgccgagacccagcacggcaccatcgtgatccgggtgcagtacgagggggacggcagcccctgcaagatccccttcgagatcatggacctcgagaagcgctacgtcctgggccggctgatcaccgtgaacccgatcgtgacggagaaggactcccccgtcaacatcgaggccgagccgcccttcggggacagctacatcatcatcggcgtggagccggggcagctcaagctgaactggttcaagaagggctccagcatcgggcagatgttcgagaccaccatgcgcggcgcgaagcgcatggccatcctgggcgacaccgcctgggacttcgggtccctcggcggggtgttcacgagcatcggcaaggccctgcaccaggtcttcggggccatctacggcgcggccttctccggcgtgagctggaccatgaagatcctgatcggggtgatcatcacctggatcggcatgaactcccggagcacctccctgagcgtctccctcgtgctggtggggatcgtcacgctgtacctcggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctcgagaacctgatgtggaagcagatcacccccgagctgaaccacatcctcgccgagaacgaggtgaagctgaccatcatgaccggggacatcaagggcatcatgcaggccgggaagcgcagcctgcggccgcagcccacggagctcaagtactcctggaagacctggggcaaggccaagatgctgagcaccgagtcctacaaccagaccttcctgatcgacggccccgagacggcggagtgcccgaacaccaaccgcgcctggaacagcctcgaggtggaggactacgggttcggcgtcttcaccaccaacatctggctgaagctgaaggagaagcaggacgccttctgcgactccaagctcatgagcgccgccatcaaggacaaccgggcggtgcacgccgacatggggtactggatcgagtccgccctgaacgacacgtggaagatcgagaaggccagcttcatcgaggtgaagaactgccactggcccaagtcccacaccctgtggagcaacggcgtcctcgagtccgagatgatcatccccaagaacctggccggccccgtgagccagcacaactaccgcccggggtaccacacccagatcgcgggcccctggcacctggggaagctcgagatggacttcgacttctgcgacggcaccaccgtgatcgtcacggaggactgcgggaaccggggcccctccctgcgcaccaccaccgccagcggcaagctgatcacggagtggtgctgccggagctgcaccctcccgcccctgcgctaccgcggggaggacggctgctggtacgggatggagatccgccccctgaaggagaaggaggagaacctcgtgaactccctggtgaccgccggccacgggcaggtcgacaacttcagcctgggcgtgctcggcatggccctgttcctggaggagatgctccggacccgcgtggggacgaagcacgcgatcctgctggtcgccgtgtccttcgtgaccctcatcaccggcaacatgagcttcaaggacctggggcgggtcgtggtgatggtcggcgccaccatgacggacgacatcgggatgggcgtgacctacctggccctcctggccgcgttcaaggtgcgccccaccttcgccgccggcctgctcctgcggaagctgacctccaaggagctcatgatgacgaccatcgggatcgtcctgctgagccagtccgccatccccgagaccgtgctcgagctgaccgacgccctggcgctcggcatgatggtgctgaagatcgtccgcaacatggagaagtaccagctggccgtgacgatcatggccatcctctgcgtccccaacgccgtgatcctgcagaacgcctggaaggtgagctgcaccatcctggcggtcgtgtccgtgagccccctcctgctgacctccagccagcagaagaccgactggatccccctcgccctgacgatcaaggggctgaaccccaccgccatcttcctcaccaccctgtcccgcacgaacaagaagcggagctggccgctgaacgaggccatcatggcggtcggcatggtgtccatcctcgccagctccctgctgaagaacgacatccccatgaccggccccctcgtggccgggggcctgctgaccgtctgctacgtgctcaccgggcgcagcgccgacctggagctggagcgggccacggacgtgaagtgggaggaccaggcggagatctccggcagcagccccatcctctccatcaccatcagcgaggacgggtccatgagcatcaagaacgaggaggaggagcagaccctgaccatcctgatccgcacgggcctcctggtcatctccggcctgttcccgatcagcatccccatcaccgccgccgcctggtacctctgggaggtgaagaagcagcgggccggggtgctgtgggacgtccccagcccgccgcccatgggcaaggcggagctggaggacggggcctaccgcatcaagcagaagggcatcctcgggtacagccagatcggcgccggcgtgtacaaggaggggaccttccacaccatgtggcacgtgacccggggcgccgtcctgatgcacaaggggaagcgcatcgagccctcctgggccgacgtgaagaaggacctgatcagctacggcgggggctggaagctcgagggcgagtggaaggagggggaggaggtgcaggtcctggcgctggagcccggcaagaacccccgggccgtgcagacgaagcccggcctcttcaagaccaacaccggcaccatcggggccgtgtccctggacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctccaccccggggccggcaagacgaagcgctacctgcccgccatcgtgcgggaggccatcaagcgcgggctgcggaccctcatcctggcgccgacccgcgtcgtggccgccgagatggaggaggccctgcggggcctccccatccgctaccagacccccgccatccgggcggagcacacggggcgcgagatcgtggacctgatgtgccacgccaccttcaccatgcgcctgctcagccccgtccgggtgccgaactacaacctgatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctctcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctgaccgacggggaggagcgggtcatcctggccggccccatgccggtgacccacagctccgccgcccagcgccgggggcgcatcggccggaaccccaagaacgagaacgaccagtacatctacatgggggagcccctcgagaacgacgaggactgcgcccactggaaggaggcgaagatgctgctggacaacatcaacacgcccgagggcatcatcccgagcatgttcgagcccgagcgcgagaaggtggacgccatcgacggcgagtaccggctccgcggggaggcccgcaagaccttcgtcgacctgatgcggcgcggcgacctgcccgtgtggctcgcctacaaggtggccgcggaggggatcaactacgccgaccggcgctggtgcttcgacggcatcaagaacaaccagatcctggaggagaacgtcgaggtggagatctggaccaaggagggggagcggaagaagctgaagccgcgctggctcgacgcccggatctactccgaccccctggccctgaaggagttcaaggagttcgccgcgggccgcaagagcctcaccctgaacctgatcacggagatgggccggctccccaccttcatgacccagaagacccgcgacgccctggacaacctggccgtcctccacacggccgaggccggcgggcgggcctacaaccacgccctgtccgagctgcccgagaccctcgagaccctgctgctcctgaccctgctcgccacggtgaccgggggcatcttcctgttcctgatgagcggccgcgggatcggcaagatgaccctcgggatgtgctgcatcatcaccgcctccaccctgctgtggtacgcgcagatccagccgcactggatcgccgccagcatcatcctcgagttcttcctgatcgtgctgctcatccccgagcccgagaagcagcggacgccccaggacaaccagctgacctacgtcgtgatcgccatcctgaccgtggtcgccgcgaccatggccaacgagatgggcttcctcgagaagacgaagaaggacctggggctgggctccatcgccacccagcagccggagagcaacatcctcgacatcgacctgcgccccgcctccgcctggaccctgtacgcggtggccaccacgttcgtgacccccatgctccggcacagcatcgagaacagctccgtcaacgtgagcctgaccgccatcgccaaccaggccaccgtgctgatgggcctcgggaagggctggcccctgtccaagatggacatcggggtcccgctgctcgcgatcggctgctacagccaggtgaaccccatcacgctgaccgccgccctgctcctgctggtggcccactacgcgatcatcgggcccggcctccaggccaaggccacccgcgaggcccagaagcgggccgcggccggcatcatgaagaaccccaccgtcgacgggatcacggtgatcgacctggacccgatcccctacgaccccaagttcgagaagcagctgggccaggtgatgctcctgatcctgtgcgtcacccaggtgctcatgatgcgcaccacctgggccctgtgcgaggccctgacgctcgccaccgggcccatctccaccctgtgggagggcaacccggggcggttctggaacaccacgatcgcggtgagcatggccaacatcttccgcggctcctacctggccggcgccgggctcctgttcagcatcatgaagaacaccaccaacacccggcgcggcacggggaacatgggcgagaccctgggcgagaagtggaagtcccgcctcaacgccctgggcaagagcgagttccagatctacaagaagtccgggatccaggaggtcgaccggaccctggcgaaggaggggatcaagcgcggcgagaccgaccaccacgccgtgagccgggggtccgccaagctccgctggttcgtggagcggaacatggtcacgcccgagggcaaggtggtggacctgggctgcgggcgcggcgggtggagctactactgcggcgggctgaagaacgtccgggaggtgaagggcctcaccaagggcgggcccggccacgaggagcccatcccgatgtccacctacgggtggaacctggtgcgcctgcagagcggcgtcgacgtgttcttcatcccgcccgagaagtgcgacaccctcctgtgcgacatcggggagtccagccccaacccgacggtggaggccggccggaccctgcgcgtcctcaacctggtggagaactggctgaacaacaacacccagttctgcatcaaggtgctgaacccctacatgccctccgtcatcgagaagatggaggcgctccagcggaagtacggcggggccctggtgcgcaacccgctgagccggaacagcacccacgagatgtactgggtgtccaacgccagcggcaacatcgtctccagcgtgaacatgatctcccgcatgctcatcaaccggttcaccatgcgccacaagaaggccacgtacgagcccgacgtggacctggggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcgtccagcatggtcaacggcgtggtgcggctcctgaccaagccgtgggacgtcctgcccaccgtgacgcagatggccatgaccgacaccacccccttcgggcagcagcgcgtgttcaaggagaaggtcgacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgctccaacgccgccctcggggcgatcttcaccgacgagaacaagtggaagtccgcccgggaggccgtggaggactcccgcttctgggagctggtcgacaaggagcggaacctgcacctcgagggcaagtgcgagacgtgcgtgtacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttctcccgggagaacagcctctccggcgtcgagggggagggcctgcacaagctggggtacatcctccgcgacgtgagcaagaaggagggcggcgccatgtacgccgacgacaccgcggggtgggacacccggatcaccctggaggacctgaagaacgaggagatggtgacgaaccacatggagggcgagcacaagaagctcgccgaggccatcttcaagctgacctaccagaacaaggtcgtgcgcgtgcagcggcccacgccccgcgggaccgtcatggacatcatcagccggcgcgaccagcggggctccggccaggtggggacctacggcctgaacaccttcaccaacatggaggcccagctcatccgccagatggagggggagggcgtgttcaagaacatccagcacctgaccgtcacggaggaggtggccgtgaagaactggctggcgcgggtcgggcgcgagcgcctcagccggatggccatctccggcgacgactgcgtggtgaagcccctggacgaccgcttcgccaacgccctgaccgccctcaacgacatgggcaagatccggaaggacatccagcagtgggagccgagcaaggggtggaacgactggacccaggtccccttctgctcccaccacttccacgagctgatcatgaaggacggccgcgtgctggtggtcccctgccggaaccaggacgagctcatcgggcgcgcgcggatcagccagggcgccgggtggtccctgcgcgagaccgcctgcctgggcaagagctacgcccagatgtggtccctcatgtacttccaccggcgcgacctgcggctggccgcgaacgccatctgcagcgccgtgccctcccactgggtgccgacgagccgcaccacctggtccatccacgccaagcacgagtggatgaccaccgaggacatgctcacggtctggaaccgggtgtggatccgcgagaacccctggatggaggacaagacccccgtggagagctgggaggagatcccctacctgggcaagcgggaggaccagtggtgcgggtccctgatcggcctcaccagccgcgccacctgggcgaagaacatccaggccgccatcaaccaggtccggtccctgatcgggaacgaggagtacgccgactacatgccgagcatgaagcgcttccggcgcgaggaggaggaggcgggcgtgctgtggtga

SEQ ID NO: 9566 - RNA, 9876 nt, synthetic construct
  misc_feature 1..9876: note = derived and/or modified CDS sequence (opt1) from DENV-2__EU482653__SS-prME
  source 1..9876: mol_type = other RNA
agcgcggggatgatcatcatgctgatccccaccgtgatggccttccacctcaccacccgcaacggggagccccacatgatcgtggggatccaggagaaggggaagtccctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcgtgaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtcgaggactacgggttcggcgtgttcaccaccaacatctggctccggctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccggccggggtaccacacccagatcgcgggcccctggcacctggggaagctggagatggacttcgacttctgcgacggcaccaccgtcatcgtgacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtcaccgccggccacggccaggtggacaacttcagcctgggcgtgctgggcatggccctcttcctggaggagatgctgcgcacccgggtcgggacgaagcacgcgatcctcctggtggccgtgtccttcgtcaccctgatcaccggcaacatgagcttcaaggacctcgggcgcgtggtggtcatggtgggcgccaccatggccgacgacatcgggatgggcgtgacgtacctggccctgctcgcggccttcaaggtccggcccaccttcgccgccggcctgctgctccgcaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcggagcgccgacctcgagctggagcgcgccacggacgtcaagtgggaggaccaggcggagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtgaagaagcagcgcgccggggtcctctgggacgtgcccagcccgccgcccatgggcaaggcggagctggaggacggggcctaccggatcaagcagaagggcatcttcgggtacagccagatcggcgccggcgtgtacaaggaggggaccttccacaccatgtggcacgtcacccgcggcgccgtgctgatgcacaaggggaagcggatcgagccctcctgggccgacgtgaagaaggacctcatcagctacggcgggggctggaagctggagggcgagtggaaggagggggaggaggtccaggtgctggcgctcgagcccggcaagaacccccgcgccgtgcagacgaagcccgggctgttcaagaccaacaccggcaccatcggggccgtctccctggacttcagccccggcacgtccggcagccccatcatcgacaagaaggggaaggtggtgggcctctacgggaacggcgtcgtgacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctgcccgccatcgtccgcgaggccatcaagcgggggctccgcaccctgatcctggcgccgacccgggtggtggccgccgagatggaggaggccctccgcggcctgcccatccggtaccagacccccgccatccgcgcggagcacacggggcgcgagatcgtcgacctgatgtgccacgccaccttcaccatgcggctcctgagccccgtgcgcgtgccgaactacaacctgatcatcatggacgaggcccacttcaccgaccccgcctccatcgccgcgcggggctacatcagcacgcgcgtcgagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtgtggttcgtcccgagcatcaaggcggggaacgacatcgccgcctgcctccgcaagaacggcaagaaggtgatccagctgtcccggaagaccttcgacagcgagtacgtgaagacccgcaccaacgactgggacttcgtcgtgacgaccgacatctccgagatgggcgccaacttcaaggcggagcgggtgatcgacccccgccggtgcatgaagcccgtcatcctgaccgacggggaggagcgcgtgatcctcgccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacgcccgagggcatcatcccgagcatgttcgagcccgagcgggagaaggtcgacgccatcgacggcgagtaccgcctgcgcggggaggcccggaagaccttcgtggacctgatgcgccggggcgacctccccgtgtggctggcctacaaggtcgccgcggaggggatcaactacgccgaccgccggtggtgcttcgacggcatcaagaacaaccagatcctggaggagaacgtggaggtcgagatctggaccaaggagggggagcgcaagaagctcaagccgcggtggctggacgcccgcatctactccgaccccctggccctcaaggagttcaaggagttcgccgcgggccggaagtccctgaccctgaacctcatcacggagatgggccgcctgcccaccttcatgacccagaagacccgggacgccctggacaacctcgccgtgctgcacacggccgaggccggcgggcgcgcctacaaccacgccctgtccgagctccccgagaccctggagaccctgctcctgctgaccctcctggccacggtgaccgggggcatcttcctgttcctcatgagcggccgggggatcggcaagatgaccctggggatgtgctgcatcatcaccgcctccatcctgctctggtacgcgcagatccagccgcactggatcgccgccagcatcatcctggagttcttcctgatcgtcctcctgatccccgagcccgagaagcagcgcacgccccaggacaaccagctgacgtacgtggtgatcgccatcctcaccgtcgtggccgcgaccatggccaacgagatgggcttcctggagaagaccaagaaggacctggggctcggctccatcgccacgcagcagccggagagcaacatcctggacatcgacctgcggcccgcctccgcctggaccctctacgcggtggccaccaccttcgtcacgcccatgctgcgccacagcatcgagaacagctccgtgaacgtgagcctgaccgccatcgccaaccaggccaccgtcctcatgggcctggggaagggctggcccctgtccaagatggacatcggggtgccgctcctggcgatcggctgctacagccaggtgaaccccatcaccctgacggccgccctcctgctgctcgtcgcccactacgcgatcatcgggcccggcctgcaggccaaggccacccgggaggcccagaagcgcgccgcggccggcatcatgaagaaccccaccgtggacgggatcaccgtgatcgacctggacccgatcccctacgaccccaagttcgagaagcagctcggccaggtcatgctgctgatcctctgcgtgacccaggtgctgatgatgcggaccacctgggccctgtgcgaggccctcaccctggccacggggcccatctccaccctgtgggagggcaacccggggcgcttctggaacaccaccatcgcggtcagcatggccaacatcttccggggctcctacctcgccggcgccgggctgctgttcagcatcatgaagaacacgaccaacgcccgccgcggcaccgggaacatgggcgagaccctcggcgagaagtggaagtcccggctgaacgcgctgggcaagagcgagttccagatctacaagaagtccggcatccaggaggtggaccgcacgctcgccaaggaggggatcaagcggggcgagaccgaccaccacgccgtgagccgcgggtccgccaagctgcggtggttcgtcgagcgcaacatggtgacccccgagggcaaggtggtcgacctgggctgcgggcggggcgggtggagctactactgcggcgggctcaagaacgtgcgcgaggtgaagggcctgaccaagggcgggcccggccacgaggagcccatcccgatgtccacgtacgggtggaacctggtccggctccagagcggcgtggacgtgttcttcatcccgcccgagaagtgcgacaccctgctgtgcgacatcggggagtccagccccaacccgaccgtcgaggcgggccgcaccctccgggtgctgaacctggtggagaactggctcaacaacaacacgcagttctgcatcaaggtcctgaacccctacatgccctccgtgatcgagaagatggaggccctgcagcgcaagtacggcggggccctggtgcggaacccgctcagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctggggagcggcacccgcaacatcgggatcgagtccgagatccccaacctcgacatcatcggcaagcggatcgagaagatcaagcaggagcacgagacgagctggcactacgaccaggaccacccctacaagacctgggcgtaccacggctcctacgagaccaagcagaccgggagcgcctccagcatggtgaacggcgtggtccgcctgctgacgaagccgtgggacgtgctccccaccgtgacccagatggccatgaccgacacgacccccttcgggcagcagcgcgtcttcaaggagaaggtggacacccggacccaggagcccaaggagggcacgaagaagctgatgaagatcaccgccgagtggctgtggaaggagctcggcaagaagaagaccccgcgcatgtgcacccgggaggagttcacgcgcaaggtgcggtccaacgccgcgctgggggccatcttcaccgacgagaacaagtggaagtccgcccgcgaggccgtcgaggactcccggttctgggagctggtggacaaggagcgcaacctccacctggagggcaagtgcgagacctgcgtctacaacatgatggggaagcgggagaagaagctgggcgagttcgggaaggccaagggcagccgcgcgatctggtacatgtggctcggcgcccggttcctggagttcgaggccctggggttcctcaacgaggaccactggttctcccgcgagaacagcctgtccggcgtggagggggagggcctgcacaagctcgggtacatcctgcgggacgtgagcaagaaggagggcggcgccatgtacgcggacgacaccgccgggtgggacacgcgcatcaccctggaggacctcaagaacgaggagatggtcaccaaccacatggagggcgagcacaagaagctggccgaggccatcttcaagctgacctaccagaacaaggtggtgcgggtccagcgccccacgccccgggggaccgtgatggacatcatcagccgccgggaccagcgcggctccggccaggtgggcacctacggcctcaacaccttcacgaacatggaggcccagctgatccggcagatggagggggagggcgtcttcaagaacatccagcacctgaccgtgaccgaggaggtggcggtccagaactggctcgcccgcgtggggcgcgagcggctgagccgcatggccatctccggcgacgactgcgtggtcaagcccctggacgaccggttcgccaacgccctcaccgcgctgaacgacatgggcaagatccgcaaggacatccagcagtgggagccgagcaaggggtggaacgactggacgcaggtccccttctgctcccaccacttccacgagctgatcatgaaggacggccgggtgctcgtcgtgccctgccgcaaccaggacgagctgatcgggcgggcccgcatcagccagggcgccgggtggtccctgcgggagaccgcctgcctcggcaagagctacgcccagatgtggtccctgatgtacttccaccgccgggacctgcgcctcgcggccaacgccatctgcagcgccgtgccctcccactgggtcccgaccagccggaccacgtggtccatccacgccaagcacgagtggatgaccaccgaggacatgctgaccgtgtggaaccgcgtgtggatccgggagaacccctggatggaggacaagacccccgtcgagagctgggaggagatcccctacctgggcaagcgcgaggaccagtggtgcgggtccctcatcggcctgacgagccgggcgacctgggccaagaacatccaggccgccatcaaccaggtgcgctccctgatcgggaacgaggagtacaccgactacatgccgagcatgaagcggttccgccgcgaggaggaggaggcgggcgtgctctggtga

SEQ ID NO: 9567 - RNA, 9876 nt, synthetic construct
  misc_feature 1..9876: note = derived and/or modified CDS sequence (opt1) from DENV-2__EU482654__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagatgaccatcatgaccggggacatcaagggcatcatgcaggccgggaagcgcagcctccggccgcagcccacggagctgaagtactcctggaagacctggggcaaggccaagatgctgagcaccgagtcctacaaccagaccttcctcatcgacggccccgagacggcggagtgcccgaacaccaaccgcgcctggaacagcctggaggtggaggactacgggttcggcgtcttcaccaccaacatctggctgaagctcaaggagaagcaggacgccttctgcgactccaagctgatgagcgccgccatcaaggacaaccgggcggtgcacgccgacatggggtactggatcgagtccgccctgaacgacacgtggaagatcgagaaggccagcttcatcgaggtgaagaactgccactggcccaagtcccacaccctctggagcaacggcgtcctggagtccgagatgatcatccccaagaacctggccggccccgtgagccagcacaactaccgcccggggtaccacacccagatcgcgggcccctggcacctcgggaagctggagatggacttcgacttctgcgacggcaccaccgtgatcgtcacggaggactgcgggaaccggggcccctccctgcgcaccaccaccgccagcggcaagctcatcacggagtggtgctgccggagctgcaccctgcccccgctgcgctaccgcggggaggacggctgctggtacgggatggagatccgccccctcaaggagaaggaggagaacctggtgaactccctggtgaccgccggccacgggcaggtcgacaacttcagcctcggcgtgctgggcatggccctgttcctcgaggagatgctgcggacccgcgtggggacgaagcacgcgatcctgctcgtcgccgtgtccttcgtgaccctgatcaccggcaacatgagcttcaaggacctggggcgggtcgtggtgatggtcggcgccaccatggccgacgacatcgggatgggcgtgacgtacctcgccctgctggcggccttcaaggtgcgccccaccttcgccgccggcctcctgctgcggaagctcacctccaaggagctgatgatgaccacgatcgggatcgtcctgctcagccagtccaccatccccgagaccgtgctggagctgaccgacgccctcgcgctgggcatgatggtgctgaagatcgtccgcaacatggagaagtaccagctcgccgtgacgatcatggccatcctgtgcgtcccgaacgccgtgatcctgcagaacgcctggaaggtgagctgcaccatcctcgcggtcgtgtccgtgagccccctgctgctcacctccagccagcagaagaccgactggatccccctggccctgacgatcaaggggctcaaccccaccgccatcttcctgaccaccctgtcccgcacgaacaagaagcggagctggccgctcaacgaggccatcatggcggtcggcatggtgtccatcctggccagctccctgctcaagaacgacatccccatgaccggccccctggtggccgggggcctgctcaccgtctgctacgtgctgaccgggcgcagcgccgacctggagctcgagcgggccacggacgtgaagtgggaggaccaggcggagatctccggcagcagccccatcctgtccatcaccatcagcgaggacgggtccatgagcatcaagaacgaggaggaggagcagaccctgaccatcctcatccgcacgggcctgctggtcatctccggcctcttcccgatcagcatccccatcaccgccgccgcctggtacctgtgggaggtgaagaagcagcgggccggggtgctgtgggacgtccccagcccgccgcccatgggcaaggcggagctcgaggacggggcctaccgcatcaagcagaagggcatcctggggtacagccagatcggcgccggcgtgtacaaggaggggaccttccacaccatgtggcacgtgacccggggcgccgtcctgatgcacaaggggaagcgcatcgagccctcctgggccgacgtgaagaaggacctcatcagctacggcgggggctggaagctggagggcgagtggaaggagggggaggaggtgcaggtcctggcgctcgagcccggcaagaacccccgggccgtgcagacgaagcccgggctgttcaagaccaacaccggcaccatcggggccgtgtccctggacttcagccccggcacgtccggcagccccatcatcgacaagaaggggaaggtcgtgggcctctacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctgcccgccatcgtgcgggaggccatcaagcgcgggctccggaccctgatcctggcgccgacccgcgtcgtggccgccgagatggaggaggccctccggggcctgcccatccgctaccagacccccgccatccgggcggagcacacggggcgcgagatcgtggacctgatgtgccacgccaccttcaccatgcgcctcctgagccccgtccgggtgccgaactacaacctgatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctccggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctgaccgacggggaggagcgggtcatcctcgccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctgctcgacaacatcaacacgcccgagggcatcatcccgagcatgttcgagcccgagcgcgagaaggtggacgccatcgacggcgagtaccggctgcgcggggaggcccgcaagaccttcgtcgacctgatgcggcgcggcgacctccccgtgtggctggcctacaaggtggccgcggaggggatcaactacgccgaccggcgctggtgcttcgacggcatcaagaacaaccagatcctggaggagaacgtcgaggtggagatctggaccaaggagggggagcggaagaagctcaagccgcgctggctggacgcccggatctactccgaccccctggccctcaaggagttcaaggagttcgccgcgggccgcaagagcctgaccctgaacctcatcacggagatgggccggctgcccaccttcatgacccagaagacccgcgacgccctggacaacctcgccgtcctgcacacggccgaggccggcgggcgggcctacaaccacgccctgtccgagctccccgagaccctggagaccctgctcctgctgaccctcctggccacggtgaccgggggcatcttcctgttcctcatgagcggccgcgggatcggcaagatgaccctggggatgtgctgcatcatcaccgcctccatcctgctctggtacgcgcagatccagccgcactggatcgccgccagcatcatcctggagttcttcctgatcgtgctcctgatccccgagcccgagaagcagcggacgccccaggacaaccagctgacgtacgtcgtgatcgccatcctcaccgtggtcgccgcgaccatggccaacgagatgggcttcctggagaagaccaagaaggacctggggctcggctccatcgccacgcagcagccggagagcaacatcctggacatcgacctgcgccccgcctccgcctggaccctctacgcggtggccaccaccttcgtgacgcccatgctgcggcacagcatcgagaacagctccgtcaacgtgagcctgaccgccatcgccaaccaggccaccgtgctcatgggcctggggaagggctggcccctgtccaagatggacatcggggtcccgctcctggcgatcggctgctacagccaggtgaaccccatcaccctgacggccgccctcctgctgctcgtggcccactacgcgatcatcgggcccggcctgcaggccaaggccacccgcgaggcccagaagcgggccgcggccggcatcatgaagaaccccaccgtcgacgggatcaccgtgatcgacctggacccgatcccctacgaccccaagttcgagaagcagctcggccaggtgatgctgctgatcctctgcgtcacccaggtgctgatgatgcgcaccacctgggccctgtgcgaggccctcaccctggccacggggcccatctccaccctgtgggagggcaacccggggcggttctggaacaccaccatcgcggtgagcatggccaacatcttccgcggctcctacctcgccggcgccgggctgctgttcagcatcatgaagaacacgaccaacacccggcgcggcaccgggaacatgggcgagacgctcggcgagaagtggaagtcccgcctgaacaccctggggaagtccgagttccagatctacaagaagtccggcatccaggaggtcgaccggaccctcgccaaggaggggatcaagcgcggcgagaccgaccaccacgcggtgagccgggggtccgccaagctgcgctggttcgtggagcggaacatggtcacgcccgagggcaaggtggtggacctgggctgcgggcgcggcgggtggagctactactgcggcgggctcaagaacgtccgggaggtgaagggcctgaccaagggcgggcccggccacgaggagcccatcccgatgtccacctacgggtggaacctggtgcgcctccagagcggcgtcgacgtgttcttcatcccgcccgagaagtgcgacaccctgctgtgcgacatcggggagtccagccccaacccgacggtggaggccggccggaccctccgcgtcctgaacctggtggagaactggctcaacaacaacacccagttctgcatcaaggtgctgaacccctacatgccctccgtcatcgagaagatggaggccctgcagcggaagtacggcggggcgctggtgcgcaacccgctcagccggaacagcacccacgagatgtactgggtgtccaacgccagcggcaacatcgtctccagcgtgaacatgatctcccgcatgctgatcaaccggttcaccatgcgccacaagaaggccacgtacgagcccgacgtggacctggggagcggcacccggaacatcgggatcgagtccgagacccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtcaacggcgtggtgcggctgctgaccaagccgtgggacgtcctccccacggtgacccagatggcgatgaccgacaccacgcccttcgggcagcagcgcgtgttcaaggagaaggtcgacacccgcacccaggagcccaaggagggcaccaagaagctgatgaagatcacggccgagtggctgtggaaggagctcggcaagaagaagaccccgcggatgtgcacccgcgaggagttcacccggaaggtgcgctccaacgccgccctgggggccatcttcacggacgagaacaagtggaagtccgcgcgggaggccgtggaggactcccgcttctgggagctggtcgacaaggagcggaacctccacctggagggcaagtgcgagacctgcgtgtacaacatgatggggaagcgcgagaagaagctgggcgagttcgggaaggccaagggcagccgggccatctggtacatgtggctcggcgcccgcttcctggagttcgaggcgctggggttcctcaacgaggaccactggttctcccgggagaacagcctgtccggcgtcgagggggagggcctgcacaagctcgggtacatcctgcgcgacgtgagcaagaaggagggcggcgccatgtacgccgacgacaccgccgggtgggacacccggatcacgctggaggacctcaagaacgaggagatggtgaccaaccacatggagggcgagcacaagaagctggcggaggccatcttcaagctgacctaccagaacaaggtcgtgcgcgtgcagcggcccacgccccgggggacggtcatggacatcatcagccggcgcgaccagcggggctccggccaggtggggacctacggcctcaacaccttcaccaacatggaggcccagctgatccgccagatggagggggagggcgtgttcaagaacatccagcacctgacggtcaccgaggaggtggccgtgcagaactggctcgcccgggtcgggcgcgagcgcctgagccggatggcgatctccggcgacgactgcgtggtgaagcccctggacgaccgcttcgccaacgccctcaccgccctgaacgacatgggcaagatccggaaggacatccagcagtgggagccgagcaaggggtggaacgactggacccaggtccccttctgctcccaccacttccacgagctgatcatgaaggacggccgcgtgctcgtggtcccctgccggaaccaggacgagctgatcgggcgcgcccggatcagccagggcgcggggtggtccctgcgcgagacggcctgcctcggcaagagctacgcccagatgtggtccctgatgtacttccaccggcgcgacctgcggctcgccgccaacgcgatctgcagcgccgtgccctcccactgggtgccgaccagccgcaccacctggtccatccacgccaagcacgagtggatgaccacggaggacatgctgaccgtctggaaccgggtgtggatccgcgagaacccctggatggaggacaagacccccgtggagagctgggaggagatcccctacctgggcaagcgggaggaccagtggtgcgggtccctcatcggcctgaccagccgcgccacgtgggccaagaacatccaggcggccatcaaccaggtccggtccctgatcgggaacgaggagtacaccgactacatgccgagcatgaagcgcttccggcgcgaggaggaggaggccggcgtgctctggtga

SEQ ID NO: 9568 - RNA, 9876 nt, synthetic construct
  misc_feature 1..9876: note = derived and/or modified CDS sequence (opt1) from DENV-2__EU482656__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcgtgaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcctggacgaggagcgggagatccccgagcgcagctggaactccgggcacgagtgggtgaccgacttcgagggcaagacggtgtggttcgtcccgagcatcaaggcggggaacgacatcgccgcctgcctgcggaagaacggcaagaaggtgatccagctctcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctgaccgacggggaggagcgggtgatcctggccggccccatgccggtgacccacagctccgccgcccagcgccgggggcgcatcggccggaaccccaagaacgagaacgaccagtacatctacatgggggagcccctcgagaacgacgaggactgcgcccactggaaggaggcgaagatgctgctggacaacatcaacacgcccgagggcatcatcccgagcatgttcgagcccgagcgcgagaaggtcgacgccatcgacggcgagtaccggctccgcggggaggcccgcaagaccttcgtggacctgatgcggcgcggcgacctgcccgtgtggctcgcctacaaggtcgccgcggaggggatcaactacgccgaccggcgctggtgcttcgacggcatcaagaacaaccagatcctggaggagaacgtggaggtcgagatctggaccaaggagggggagcggaagaagctgaagccgcgctggctcgacgcccggatctactccgaccccctggccctgaaggagttcaaggagttcgccgcgggccgcaagagcctcaccctgaacctgatcacggagatgggccggctccccaccttcatgacccagaagacccgcgacgccctggacaacctggccgtgctccacacggccgaggccggcgggcgggcctacaaccacgccctgtccgagctgcccgagaccctcgagaccctgctgctcctgaccctgctcgccacggtgaccgggggcatcttcctgttcctgatgagcggccgcgggatcggcaagatgaccctcgggatgtgctgcatcatcaccgcctccatcctgctgtggtacgcgcagatccagccgcactggatcgccgccagcatcatcctcgagttcttcctgatcgtcctgctcatccccgagcccgagaagcagcggacgccccaggacaaccagctgacgtacgtggtgatcgccatcctgaccgtcgtggccgcgaccatggccaacgagatgggcttcctcgagaagaccaagaaggacctggggctgggctccgtggccacgcagcagccggagagcaacatcctcgacatcgacctgcgccccgcctccgcctggaccctgtacgcggtcgccaccaccttcgtgacgcccatgctccggcacagcatcgagaacagctccgtgaacgtcagcctgaccgccatcgccaaccaggccaccgtgctgatgggcctcgggaagggctggcccctgtccaagatggacatcggggtgccgctgctcgcgatcggctgctacagccaggtcaaccccatcaccctgacggccgccctgctcctgctggtggcccactacgcgatcatcgggcccggcctccaggccaaggccacccgcgaggcccagaagcgggccgcggccggcatcatgaagaaccccaccgtggacgggatcaccgtcatcgacctggacccgatcccctacgaccccaagttcgagaagcagctgggccaggtgatgctcctgatcctgtgcgtgacgcaggtcctcatgatgcgcaccacctgggccctgtgcgaggccctgaccctcgccacggggcccatctccaccctgtgggagggcaacccggggcggttctggaacaccaccatcgcggtgagcatggccaacatcttccgcggctcctacctggccggcgccgggctcctgttcagcatcatgaagaacacgaccaacacccggcgcggcaccgggaacatgggcgagacgctgggcgagaagtggaagtcccgcctcaacgccctggggaagtccgagttccagatctacaagaagtccggcatccaggaggtggaccggaccctggcgaaggaggggatcaagcgcggcgagaccgaccaccacgccgtcagccgggggtccgccaagctccgctggttcgtggagcggaacatggtgacccccgagggcaaggtcgtggacctgggctgcgggcgcggcgggtggagctactactgcggcgggctgaagaacgtgcgggaggtcaagggcctcacgaagggcgggcccggccacgaggagcccatcccgatgtccacctacgggtggaacctggtgcgcctgcagagcggcgtggacgtcttcttcatcccgcccgagaagtgcgacaccctcctgtgcgacatcggggagtccagccccaacccgaccgtggaggccggccggacgctgcgcgtgctcaacctggtcgagaactggctgaacaacaacacccagttctgcatcaaggtgctgaacccctacatgccctccgtgatcgagaagatggaggcgctccagcggaagtacggcggggccctggtccgcaacccgctgagccggaacagcacccacgagatgtactgggtgtccaacgccagcggcaacatcgtgtccagcgtcaacatgatctcccgcatgctcatcaaccggttcaccatgcgccacaagaaggccacctacgagcccgacgtggacctggggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcggctcctgaccaagccgtgggacgtgctgcccaccgtcacccagatggccatgacggacaccacccccttcgggcagcagcgcgtgttcaaggagaaggtggacacccgcacgcaggagcccaaggagggcaccaagaagctcatgaagatcaccgccgagtggctgtggaaggagctgggcaagaagaagaccccgcggatgtgcacgcgcgaggagttcacccggaaggtccgctccaacgccgccctcggggcgatcttcaccgacgagaacaagtggaagtccgcccgggaggccgtggaggactcccgcttctgggagctggtcgacaaggagcggaacctgcacctcgagggcaagtgcgagacctgcgtgtacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttctcccgggagaacagcctctccggcgtggagggggagggcctgcacaagctggggtacatcctccgcgacgtcagcaagaaggagggcggcgccatgtacgccgacgacacggcggggtgggacacccggatcaccctggaggacctgaagaacgaggagatggtgaccaaccacatggagggcgagcacaagaagctcgccgaggccatcttcaagctgacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctcatccgccagatggagggggagggcgtgttcaagaacatccagcacctgaccgtgaccgaggaggtcgccgtgcagaactggctggcgcgggtggggcgcgagcgcctcagccggatggccatctccggcgacgactgcgtcgtgaagcccctggacgaccgcttcgccaacgccctgacggccctcaacgacatgggcaagatccggaaggacatccagcagtgggagccgagcaaggggtggaacgactggacccaggtgcccttctgctcccaccacttccacgagctgatcatgaaggacggccgcgtcctggtggtgccctgccggaaccaggacgagctcatcgggcgcgcgcggatcagccagggcgccgggtggtccctgcgcgagaccgcctgcctgggcaagagctacgcccagatgtggtccctcatgtacttccaccggcgcgacctgcggctggccgcgaacgccatctgcagcgccgtcccctcccactgggtgccgaccagccgcacgacctggtccatccacgccaagcacgagtggatgaccaccgaggacatgctcaccgtgtggaaccgggtctggatccgcgagaacccctggatggaggacaagacgcccgtggagagctgggaggagatcccctacctgggcaagcgggaggaccagtggtgcgggtccctgatcggcctcaccagccgcgccacctgggcgaagaacatccaggccgccatcaaccaggtgcggtccctgatcgggaacgaggagtacaccgactacatgccgagcatgaagcgcttccggcgcgaggaggaggaggccggcgtcctgtggtga

SEQ ID NO: 9569 - RNA, 9876 nt, synthetic construct
  misc_feature 1..9876: note = derived and/or modified CDS sequence (opt1) from DENV-2__EU482657__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcatgcggcacccgggcttcacgatcatggccgcgatcctggcctacaccatcgggaccacccacttccagcgcgtcctgatcttcatcctcctgacggccgtggccccctccatgaccatgcggtgcatcggcatcagcaaccgcgacttcgtggagggcgtctccgggggcagctgggtggacatcgtgctggagcacgggtcctgcgtcaccaccatggcgaagaacaagcccacgctcgacttcgagctgatcaagaccgaggccaagcagcccgccaccctgcggaagtactgcatcgaggccaagctcaccaacacgaccaccgagagccgctgccccacccagggcgagccctccctgaaggaggagcaggacaagcggttcgtgtgcaagcacagcatggtggaccgcggctgggggaacggctgcgggctgttcggcaagggcgggatcgtcacgtgcgccatgttcacgtgcaagaagaacatggagggcaagatcgtgcagcccgagaacctcgagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctggacttcaacgagatggtgctcctgcagatggagaacaaggcctggctggtgcaccgccagtggttcctcgacctgcccctgccctggctcccgggggccgacaagcaggagtccaactggatccagaaggagaccctggtcaccttcaagaacccccacgccaagaagcaggacgtggtcgtgctgggcagccaggagggggcgatgcacacggccctcaccggcgccaccgagatccagatgagctccgggaacctgctgttcaccggccacctcaagtgccggctgcgcatggacaagctgcagctcaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctgggccggctcatcaccgtgaacccgatcgtgacggagaaggactcccccgtcaacatcgaggccgagccgcccttcggggacagctacatcatcatcggcgtggagccggggcagctgaagctgaactggttcaagaagggctccagcatcgggcagatgttcgagaccaccatgcgcggcgcgaagcgcatggccatcctcggcgacaccgcctgggacttcgggtccctgggcggggtgttcacgagcatcggcaaggccctgcaccaggtcttcggggccatctacggcgcggccttctccggcgtgagctggaccatgaagatcctcatcggggtgatcatcacctggatcggcatgaactcccggagcacctccctgagcgtctccctggtgctggtggggatcgtcacgctctacctgggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctcgccagcgcgatccagaaggcccaggaggaggggatctgcggcatccgctccgtcacgcggctggagaacctgatgtggaagcagatcacccccgagctcaaccacatcctggccgagaacgaggtgaagctgaccatcatgaccggggacatccgcggcatcatgcaggccgggaagcggagcctccgcccgcagcccacggagctgaagtactcctggaagacctggggcaaggccaagatgctgagcaccgagtcctacaaccagaccttcctcatcgacggccccgagacggcggagtgcccgaacaccaaccgggcctggaacagcctggaggtggaggactacgggttcggcgtcttcaccaccaacatctggctgaagctcaaggagaagcaggacgccttctgcgactccaagctgatgagcgccgccatcaaggacaaccgcgcggtgcacgccgacatggggtactggatggagtccgccctgaacgacacgtggaagatcgagaaggccagcttcatcgaggtgaagaactgccactggcccaagtcccacaccctctggagcaacggcgtcctggagtccgagatgatcatccccaagaacctggccggccccgtgagccagcacaactaccggccggggtaccacacccagatcgcgggcccctggcacctcgggaagctggagatggacttcgacttctgcgacggcaccaccgtgatcgtcacggaggactgcgggaaccgcggcccctccctgcggaccaccaccgccagcggcaagctcatcacggagtggtgctgccgcagctgcaccctgcccccgctgcggtaccgcggggaggacggctgctggtacgggatggagatccggcccctcaaggagaaggaggagaacctggtgaactccctggtgaccgccggccacgggcaggtcgacaacttcagcctcggcgtgctgggcatggccctgttcctcgaggagatgctgcgcacccgggtggggacgaagcacgcgatcctgctcgtcgccgtgtccttcgtgaccctgatcaccggcaacatgagcttcaaggacctggggcgcgtcgtggtgatggtcggcgccaccatggccgacgacatcgggatgggcgtgacgtacctcgccctgctggcggccttcaaggtgcggcccaccttcgccgccggcctcctgctgcgcaagctcacctccaaggagctgatgatgaccacgatcgggatcgtcctgctcagccagtccaccatccccgagaccgtgctggagctgaccgacgccctcgcgctgggcatgatggtgctgaagatcgtccgcaacatggagaagtaccagctcgccgtgacgatcatggccatcctgtgcgtcccgaacgccgtgatcctgcagaacgcctggaaggtgagctgcaccatcctcgcggtcgtgtccgtgagccccctgctgctcacctccagccagcagaagaccgactggatccccctggccctgacgatcaaggggctcaaccccaccgccatcttcctgaccaccctgtcccggacgaacaagaagcgcagctggccgctcaacgaggccatcatggcggtcggcatggtgtccatcctggccagctccctgctcaagaacgacatccccatgaccggccccctggtggccgggggcctgctcaccgtctgctacgtgctgaccgggcggagcgccgacctggagctcgagcgcgccacggacgtgaagtgggaggaccaggcggagatctccggcagcagccccatcctgtccatcaccatcagcgaggacgggtccatgagcatcaagaacgaggaggaggagcagaccctgaccatcctcatccggacgggcctgctggtcatctccggcctcttcccgatcagcatccccatcaccgccgccgcctggtacctgtgggaggtgaagaagcagcgcgccggggtgctgtgggacgtccccagcccgccgcccatgggcaaggcggagctcgaggacggggcctaccggatcaagcagaagggcatcctggggtacagccagatcggcgccggcgtgtacaaggaggggaccttccacaccatgtggcacgtgacccgcggcgccgtcctgatgcacaaggggaagcggatcgagccctcctgggccgacgtgaagaaggacctcatcagctacggcgggggctggaagctggagggcgagtggaaggagggggaggaggtgcaggtcctggcgctcgagcccggcaagaacccccgcgccgtgcagacgaagcccgggctgttcaagaccaacaccggcaccatcggggccgtgtccctggacttcagccccggcacgtccggcagccccatcatcgacaagaaggggaaggtcgtgggcctctacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctgcccgccatcgtgcgcgaggccatcaagcgggggctccgcaccctgatcctggcgccgacccgggtcgtggccgccgagatggaggaggccctccgcggcctgcccatccggtaccagacccccgccatccgcgcggagcacacggggcgcgagatcgtggacctgatgtgccacgccaccttcaccatgcggctcctgagccccgtccgcgtgccgaactacaacctgatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctccgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctgaccgacggggaggagcgcgtcatcctcgccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacgcccgagggcatcatcccgagcatgttcgagcccgagcgggagaaggtggacgccatcgacggcgagtaccgcctgcgcggggaggcccggaagaccttcgtcgacctgatgcgccggggcgacctccccgtgtggctggcctacaaggtggccgcggaggggatcaactacgccgaccgccggtggtgcttcgacggcatcaagaacaaccagatcctggaggagaacgtcgaggtggagatctggaccaaggagggggagcgcaagaagctcaagccgcggtggctggacgcccgcatctactccgaccccctggccctcaaggagttcaaggagttcgccgcgggccggaagtccctgaccctgaacctcatcacggagatgggccgcctgcccaccttcatgacccagaagacccgggacgccctggacaacctcgccgtcctgcacacggccgaggccggcgggcgcgcctacaaccacgccctgtccgagctccccgagaccctggagaccctgctcctgctgaccctcctggccacggtgaccgggggcatcttcctgttcctcatgagcggccgggggatcggcaagatgaccctggggatgtgctgcatcatcaccgcctccaccctgctctggtacgcgcagatccagccgcactggatcgccgccagcatcatcctggagttcttcctgatcgtgctcctgatccccgagcccgagaagcagcgcacgccccaggacaaccagctgacctacgtcgtgatcgccatcctcaccgtggtcgccgcgaccatggccaacgagatgggcttcctggagaagacgaagaaggacctggggctcggctccatcgccacccagcagccggagagcaacatcctggacatcgacctgcggcccgcctccgcctggaccctctacgcggtggccaccacgttcgtgacccccatgctgcgccacagcatcgagaacagctccgtcaacgtgagcctgaccgccatcgccaaccaggccaccgtgctcatgggcctggggaagggctggcccctgtccaagatggacatcggggtcccgctcctggcgatcggctgctacagccaggtgaaccccatcacgctgaccgccgccctcctgctgctcgtggcccactacgcgatcatcgggcccggcctgcaggccaaggccacccgggaggcccagaagcgcgccgcggccggcatcatgaagaaccccaccgtcgacgggatcacggtgatcgacctggacccgatcccctacgaccccaagttcgagaagcagctcggccaggtgatgctgctgatcctctgcgtcacccaggtgctgatgatgcggaccacctgggccctgtgcgaggccctcacgctggccaccgggcccatctccaccctgtgggagggcaacccggggcgcttctggaacaccacgatcgcggtgagcatggccaacatcttccggggctcctacctcgccggcgccgggctgctgttcagcatcatgaagaacaccaccaacacccgccgcggcacggggaacatcggcgagaccctcggcgagaagtggaagtcccggctgaacgccctgggcaagagcgagttccagatctacaagaagtccggcatccaggaggtcgaccgcaccctcgcgaaggaggggatcaagcggggcgagaccgaccaccacgccgtgagccgcgggtccgccaagctgcggtggttcgtggagcgcaacatggtcacgcccgagggcaaggtggtggacctgggctgcgggcggggcgggtggagctactactgcggcgggctcaagaacgtccgcgaggtgaagggcctgaccaagggcgggcccggccacgaggagcccatcccgatgtccacctacgggtggaacctggtgcggctccagagcggcgtcgacgtgttcttcatcccgcccgagaagtgcgacaccctgctgtgcgacatcggggagtccagccccaacccgacggtggaggccggccgcaccctccgggtcctgaacctggtggagaactggctcaacaacaacacccagttctgcatcaaggtgctgaacccctacatgccctccgtcatcgagaagatggaggcgctgcagcgcaagtacggcggggccctggtgcggaacccgctcagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctggggagcggcacccgcaacatcgggatcgagtccgagatccccaacctcgacatcatcggcaagcggatcgagaagatcaagcaggagcacgaggccagctggcactacgaccaggaccacccctacaagacctgggcgtaccacggctcctacgagaccaagcagacggggagcgcctccagcatggtcaacggcgtggtgcgcctgctgaccaagccgtgggacgtcctccccaccgtgacccagatggccatgacggacaccacccccttcgggcagcagcgcgtgttcaaggagaaggtcgacacccggacgcaggagcccaaggagggcaccaagaagctgatgaagatcaccgccgagtggctgtggaaggagctcggcaagaagaagaccccgcgcatgtgcacgcgggaggagttcacccgcaaggtgcggtccaacgccgcgctgggggccatcttcaccgacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggccaagggcagccgcgcgatctggtacatgtggctcggcgcccggttcctggagttcgaggccctggggttcctcaacgaggaccactggttctcccgcgagaacagcctgtccggcgtcgagggggagggcctgcacaagctcgggtacatcctgcgggacgtgagcaagaaggagggcggcgccatgtacgcggacgacacggccgggtgggacacccgcatcaccctggaggacctcaagaacgaggagatggtgaccaaccacatggagggcgagcacaagaagctggccgaggccatcttcaagctgacgtaccagaacaaggtcgtgcgggtgcagcgccccacgccccgggggaccgtcatggacatcatcagccgccgggaccagcgcggctccggccaggtgggcacctacggcctcaacacgttcaccaacatggaggcccagctgatccggcagatggagggggagggcgtgttcaagaacatccagcacctgaccgtcaccgaggaggtggcggtgcacaactggctcgcccgcgtcgggcgcgagcggctgagccgcatggccatctccggcgacgactgcgtggtgaagcccctggacgaccggttcgccaacgccctcacggcgctgaacgacatgggcaagatccgcaaggacatccagcagtgggagccgagcaaggggtggaacgactggacccaggtccccttctgctcccaccacttccacgagctgatcatgaaggacggccgggtgctcgtggtcccctgccgcaaccaggacgagctgatcgggcgggcccgcatcagccagggcgccgggtggtccctgcgggagaccgcctgcctcggcaagagctacgcccagatgtggtccctgatgtacttccaccgccgggacctgcgcctcgcggccaacgccatctgcagcgccgtgccctcccactgggtgccgaccagccggacgacctggtccatccacgccaagcacgagtggatgaccaccgaggacatgctgaccgtctggaaccgcgtgtggatccgggagaacccctggatggaggacaagacgcccgtggagagctgggaggagatcccctacctgggcaagcgcgaggaccagtggtgcgggtccctcatcggcctgaccagccgggcgacctgggccaagaacatccaggccgccatcaaccaggtccgctccctgatcgggaacgaggagtacaccgactacatgccgagcatgaagcggttccgccgcgaggaggaggaggcgggcgtgctctggtga

SEQ ID NO: 9570 - RNA, 9876 nt, synthetic construct
  misc_feature 1..9876: note = derived and/or modified CDS sequence (opt1) from DENV-2__EU482658__SS-prME
  source 1..9876: mol_type = other RNA
agcgcggggatgatcatcatgctgatccccaccgtgatggccttccacctcaccacccgcaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtgatcgtcctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtgttcaccacgaacatctggctcaagctgaaggagaagcaggacgccttctgcgactccaagctgatgagcgccgccatcaaggacaaccgggccgtccacgcggacatggggtactggatcgagtccgccctcaacgacacctggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgccggcccctggcacctggggaagctggagatggacttcgacttctgcgacggcaccacggtgatcgtgaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacgcgcgtggggaccaagcacgccatcctcctggtgaccgtctccttcgtgaccctgatcacgggcaacatgagcttcaaggacctcgggcgggtggtcgtgatggtgggcgcgaccatggccgacgacatcgggatgggcgtcacctacctggccctgctcgccgccttcaaggtgcgccccaccttcgcggccggcctgctgctccggaagctgacgtccaaggagctgatgatgaccaccatcgggatcgtgctcctgagccagtccaccatccccgagacggtcctggagctcaccgacgccctggccctgggcatgatggtgctcaagatcgtgcgcaacatggagaagtaccagctggccgtcaccatcatggcgatcctgtgcgtgccgaacgccgtcatcctccagaacgcctggaaggtgagctgcaccatcctggccgtggtctccgtgagccccctgctcctgacgtccagccagcagaagaccgactggatccccctggccctcaccatcaaggggctgaaccccaccgcgatcttcctgacgaccctctcccgcaccaacaagaagcggagctggccgctgaacgaggccatcatggccgtgggcatggtctccatcctggccagctccctcctgaagaacgacatccccatgaccggccccctggtggccggcgggctcctgacggtgtgctacgtcctgaccgggcgcagcgccgacctcgagctggagcgggccaccgacgtgaagtgggaggaccaggccgagatctccgggagcagccccatcctgtccatcaccatcagcgaggacgggtccatgagcatcaagaacgaggaggaggagcagacgctcaccatcctgatccgcaccggcctgctcgtgatctccggcctgttcccgatcagcatccccatcaccgccgcggcctggtacctgtgggaggtcaagaagcagcgggccggggtgctctgggacgtgcccagcccgccgcccatgggcaaggccgagctggaggacggggcctaccgcatcaagcagaagggcatcctggggtacagccagatcggcgcgggcgtctacaaggaggggaccttccacacgatgtggcacgtgacccggggcgccgtgctcatgcacaaggggaagcgcatcgagccctcctgggccgacgtcaagaaggacctgatcagctacggcgggggctggaagctggagggcgagtggaaggagggggaggaggtccaggtgctcgccctggagcccggcaagaacccccgggccgtccagaccaagcccgggctgttcaagaccaacacgggcaccatcggggcggtgtccctcgacttcagccccggcacctccggcagccccatcatcgacaagaaggggaaggtggtcggcctgtacgggaacggcgtggtgacccgctccggcgcctacgtcagcgccatcgcccagacggagaagtccatcgaggacaaccccgagatcgaggacgacatcttccggaagcgccggctgaccatcatggacctgcaccccggggccggcaagaccaagcgctacctccccgcgatcgtgcgggaggccatcaagcgcgggctgcggaccctgatcctcgccccgacgcgcgtggtcgccgcggagatggaggaggccctgcggggcctgcccatccgctaccagacccccgccatccgggccgagcacaccgggcgcgagatcgtggacctcatgtgccacgccaccttcacgatgcgcctgctgagccccgtgcgggtcccgaactacaacctcatcatcatggacgaggcgcacttcaccgaccccgcctccatcgccgcccgcggctacatcagcacccgggtggagatgggcgaggccgcggggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagaccgtctggttcgtgccgagcatcaaggccgggaacgacatcgccgcgtgcctgcggaagaacggcaagaaggtgatccagctgtcccgcaagaccttcgacagcgagtacgtcaagacgcggaccaacgactgggacttcgtggtgaccaccgacatctccgagatgggcgccaacttcaaggccgagcgcgtcatcgacccccggcgctgcatgaagcccgtgatcctcacggacggggaggagcgggtgatcctggccggccccatgccggtcacccacagctccgcggcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgccatcgacggcgagtaccggctgcgcggggaggcgcgcaagaccttcgtggacctcatgcggcgcggcgacctgcccgtctggctggcctacaaggtggccgccgaggggatcaactacgccgaccggcgctggtgcttcgacggcatcaagaacaaccagatcctcgaggagaacgtggaggtcgagatctggacgaaggagggggagcggaagaagctgaagccgcgctggctggacgcgcggatctactccgaccccctcgccctgaaggagttcaaggagttcgccgccggccgcaagagcctgaccctcaacctgatcaccgagatgggccggctgcccaccttcatgacgcagaagacccgcgacgccctcgacaacctggcggtgctgcacaccgccgaggccgggggccgggcctacaaccacgcgctctccgagctgcccgagaccctggagacgctcctgctgctcaccctgctggccaccgtcaccgggggcatcttcctcttcctgatgagcggccgcgggatcggcaagatgaccctggggatgtgctgcatcatcacggcctccatcctcctgtggtacgcccagatccagccgcactggatcgccgcgagcatcatcctggagttcttcctcatcgtgctgctgatccccgagcccgagaagcagcggacgccccaggacaaccagctcacctacgtggtcatcgccatcctgaccgtggtggccgccacgatggccaacgagatgggcttcctggagaagaccaagaaggacctcgggctgggctccatcgcgacccagcagccggagagcaacatcctggacatcgacctccgccccgcctccgcctggaccctgtacgccgtcgccacgaccttcgtgacccccatgctgcggcacagcatcgagaacagctccgtgaacgtcagcctcaccgcgatcgccaaccaggccacggtgctgatgggcctggggaagggctggcccctctccaagatggacatcggggtgccgctgctggccatcggctgctacagccaggtcaaccccatcaccctcaccgccgcgctgctgctcctggtggcccactacgccatcatcgggcccggcctgcaggccaaggcgacccgcgaggcccagaagcgggccgccgccggcatcatgaagaaccccacggtggacgggatcaccgtcatcgacctcgacccgatcccctacgaccccaagttcgagaagcagctgggccaggtgatgctgctcatcctgtgcgtgacccaggtcctgatgatgcgcaccacgtgggcgctctgcgaggccctgaccctggccaccgggcccatctccaccctctgggagggcaacccggggcggttctggaacacgaccatcgccgtgagcatggccaacatcttccgcggctcctacctggcgggcgccgggctcctcttcagcatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtggaccggaccctggccaaggaggggatcaagcgcggcgagacggaccaccacgccgtcagccgggggtccgcgaagctgcgctggttcgtggagcggaacatggtgacccccgagggcaaggtcgtggacctcggctgcgggcgcggcgggtggagctactactgcggcgggctgaagaacgtgcgggaggtcaagggcctgaccaagggcgggcccggccacgaggagcccatcccgatgtccacctacgggtggaacctcgtgcgcctgcagagcggcgtggacgtcttcttcatcccgcccgagaagtgcgacacgctgctctgcgacatcggggagtccagccccaacccgaccgtggaggccggccggaccctgcgcgtgctgaacctcgtcgagaactggctgaacaacaacacccagttctgcatcaaggtgctgaacccctacatgccctccgtgatcgagaagatggaggccctgcagcggaagtacggcggggccctcgtccgcaacccgctgagccggaacagcacccacgagatgtactgggtgtccaacgcgagcggcaacatcgtgtccagcgtcaacatgatctcccgcatgctgatcaaccggttcacgatgcgccacaagaaggccacctacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacgtgggcctaccacggctcctacgagaccaagcagaccgggagcgcctccagcatggtgaacggcgtcgtgcggctgctcaccaagccgtgggacgtgctgcccacggtcacccagatggccatgaccgacaccacgcccttcgggcagcagcgcgtgttcaaggagaaggtggacacccgcacccaggagcccaaggagggcaccaagaagctgatgaagatcacggcggagtggctctggaaggagctgggcaagaagaagaccccgcggatgtgcacccgcgaggagttcacccggaaggtccgctccaacgccgccctgggggccatcttcacggacgagaacaagtggaagtccgcccgggaggcggtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcccgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgcgatgtacgccgacgacaccgccgggtgggacacccggatcacgctcgaggacctgaagaacgaggagatggtgaccaaccacatggagggcgagcacaagaagctggccgaggcgatcttcaagctcacctaccagaacaaggtggtccgcgtgcagcggcccacgccccgggggacggtgatggacatcatcagccggcgcgaccagcggggctccgggcaggtcggcacctacggcctgaacaccttcaccaacatggaggcccagctgatccgccagatggagggggagggcgtgttcaagaacatccagcacctcacggtgaccgaggaggtcgccgtgcagaactggctggcccgggtggggcgcgagcgcctgagccggatggccatctccggcgacgactgcgtcgtgaagcccctcgacgaccgcttcgcgaacgccctgaccgccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcccggatcagccagggcgccgggtggtccctccgcgagacggcgtgcctgggcaagagctacgcccagatgtggtccctgatgtacttccaccggcgcgacctccggctggccgccaacgccatctgcagcgcggtcccctcccactgggtgccgaccagccgcaccacctggtccatccacgccaagcacgagtggatgaccacggaggacatgctgaccgtgtggaaccgggtctggatccgcgacaacccctggatggaggacaagacccccgtggagagctgggaggagatcccctacctcggcaagcgggaggaccagtggtgcgggtccctgatcggcctgaccagccgcgccacgtgggccaagaacatccaggccgcgatcaaccaggtgcggtccctcatcgggaacgaggagtacaccgactacatgccgagcatgaagcgcttccggcgcgaggaggaggaggccggcgtcctgtggtga

SEQ ID NO: 9571 - RNA, 9876 nt, synthetic construct
  misc_feature 1..9876: note = derived and/or modified CDS sequence (opt1) from DENV-2__EU482659__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcgcggtgtccttcgtgaccctgatcaccggcaacatgagcttcaaggacctcgggcgggtcgtggtgatggtcggcgccacgatggccgacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaacacggggcacgagtgggtcaccgacttcaagggcaagaccgtgtggttcgtgccgtccatcaaggccgggaacgacatcgcggcctgcctgcggaagaacggcaagaaggtcatccagctgagccgcaagaccttcgactccgagtacgtgaagacgcggaccaacgactgggacttcgtggtcaccaccgacatcagcgagatgggcgccaacttcaaggccgagcgcgtgatcgacccccggcgctgcatgaagcccgtgatcctcacggacggggaggagcgggtcatcctggcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggacgaaggagggggagcggaagaagctgaagccgcgctggctggacgcccggatctacagcgaccccctcgccctgaaggagttcaaggagttcgccgccggccgcaagtccctgaccctcaacctgatcaccgagatgggccggctgcccaccttcatgacgcagaagacccgcgacgcgctcgacaacctggccgtcctgcacaccgccgaggccgggggccgggcgtacaaccacgccctcagcgagctgcccgagaccctggagacgctcctgctgctcaccctgctggccaccgtgaccgggggcatcttcctcttcctgatgtccggccgcgggatcggcaagatgaccctggggatgtgctgcatcatcacggccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgaccgtggtcgccgccacgatggcgaacgagatgggcttcctggagaagaccaagaaggacctcgggctgggcagcatcgccacccagcagccggagtccaacatcctggacatcgacctccgccccgccagcgcctggaccctgtacgccgtggcgacgaccttcgtgacccccatgctgcggcactccatcgagaacagcagcgtcaacgtgtccctcaccgccatcgccaaccaggccacggtgctgatgggcctggggaagggctggcccctcagcaagatggacatcggggtcccgctgctggccatcggctgctactcccaggtgaaccccatcaccctcaccgcggccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggccctctgcgaggccctgaccctggccaccgggcccatcagcaccctctgggagggcaacccggggcggttctggaacacgaccatcgccgtgtccatggcgaacatcttccgcggcagctacctggccggcgccgggctcctcttctccatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtcgaccggaccctggccaaggaggggatcaagcgcggcgagacggaccaccacgcggtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgaccaagggcgggcccggccacgaggagcccatcccgatgagcacctacgggtggaacctcgtgcgcctgcagtccggcgtcgacgtgttcttcatcccgcccgagaagtgcgacacgctgctctgcgacatcggggagagctcccccaacccgaccgtggaggccggccggaccctgcgcgtcctgaacctcgtggagaactggctgaacaacaacacccagttctgcatcaaggtgctgaacccctacatgcccagcgtcatcgagaagatggaggccctgcagcggaagcacggcggggcgctcgtgcgcaacccgctgtcccggaacagcacccacgagatgtactgggtgagcaacgcctccggcaacatcgtcagctccgtgaacatgatcagccgcatgctgatcaaccggttcacgatgcgccacaagaaggccacctacgagcccgacgtggacctcgggtccggcacccggaacatcgggatcgagagcgagatccccaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtcaacggcgtggtgcggctgctcaccaagccgtgggacgtcctgcccacggtgacccagatggcgatgaccgacaccacgcccttcgggcagcagcgcgtgttcaaggagaaggtcgacacccgcacccaggagcccaaggagggcaccaagaagctgatgaagatcacggccgagtggctctggaaggagctgggcaagaagaagaccccgcggatgtgcacccgcgaggagttcacccggaaggtgcgcagcaacgccgccctgggggccatcttcacggacgagaacaagtggaagtccgcgcgggaggccgtggaggacagccgcttctgggagctcgtcgacaaggagcggaacctgcacctggagggcaagtgcgagacctgcgtgtacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtcgagggggagggcctccacaagctggggtacatcctgcgcgacgtgtccaagaaggagggcggcgccatgtacgccgacgacaccgccgggtgggacacccggatcacgctcgaggacctgaagaacgaggagatggtgaccaaccacatggagggcgagcacaagaagctggcggaggccatcttcaagctcacctaccagaacaaggtcgtgcgcgtgcagcggcccacgccccgggggacggtcatggacatcatcagccggcgcgaccagcggggcagcggccaggtggggacctacggcctgaacaccttcaccaacatggaggcccagctgatccgccagatggagggggagggcgtgttcaagaacatccagcacctcacggtcaccgaggaggtggccgtgcagaactggctggcccgggtcgggcgcgagcgcctgtcccggatggcgatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcccggatctcccagggcgcggggtggagcctccgcgagacggcctgcctgggcaagtcctacgcccagatgtggagcctgatgtacttccaccggcgcgacctccggctggccgccaacgcgatctgctccgccgtgcccagccactgggtgccgacctcccgcaccacctggagcatccacgccaagcacgagtggatgaccacggaggacatgctgaccgtctggaaccgggtgtggatccgcgagaacccctggatggaggacaagacccccgtggagtcctgggaggagatcccctacctcggcaagcgggaggaccagtggtgcgggagcctgatcggcctgacctcccgcgccacgtgggccaagaacatccaggcggccatcaaccaggtccggagcctcatcggggacgaggagtacaccgactacatgccgtccatgaagcgcttccggcgcgaggaggaggaggccggcgtgctgtggtga

SEQ ID NO: 9572 - RNA, 9876 nt, synthetic construct
  misc_feature 1..9876: note = derived and/or modified CDS sequence (opt1) from DENV-2__EU482661__SS-prME
  source 1..9876: mol_type = other RNA
agcgccgggatgatcatcatgctgatccccaccgtgatggccttccacctcaccacccgcaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtgggcatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgagggggacatcttccggaagcgccggctgaccatcatggacctgcaccccggcgccgggaagacgaagcgctacctccccgccatcgtgcgggaggccatcaagcgcggcctgcggaccctgatcctcgcgccgacccgcgtcgtggccgccgagatggaggaggccctgcgggggctgcccatccgctaccagacccccgccatccgggcggagcacacgggccgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggggaggccgccggcatcttcatgaccgccacgccgcccgggagccgcgacccgttcccccagtccaacgcccccatcatcgacgaggagcgggagatccccgagcgcagctggaactccggccacgagtgggtcaccgacttcaaggggaagacggtgtggttcgtgccgagcatcaaggcgggcaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggggccaacttcaaggcggagcgcgtgatcgacccccggcgctgcatgaagcccgtgatcctcaccgacggcgaggagcgggtcatcctggccgggcccatgccggtgacccacagctccgccgcccagcgccggggccgcatcgggcggaaccccaagaacgagaacgaccagtacatctacatgggcgagcccctggagaacgacgaggactgcgcccactggaaggaggcgaagatgctcctggacaacatcaacacgcccgagggcatcatcccgagcatgttcgagcccgagcgcgagaaggtggacgccatcgacggggagtaccggctgcgcggcgaggcccgcaagaccttcgtcgacctcatgcggcgcggggacctgcccgtgtggctggcctacaaggtggccgcggagggcatcaactacgccgaccggcgctggtgcttcgacgggatcaagaacaaccagatcctcgaggagaacgtcgaggtggagatctggaccaaggagggcgagcggaagaagctgaagccgcgctggctggacgcccggatctactccgaccccctcgccctgaaggagttcaaggagttcgccgcgggccgcaagagcctgaccctcaacctgatcacggagatggggcggctgcccaccttcatgacccagaagacccgcgacgccctcgacaacctggccgtcctgcacacggccgaggcgggcgggcgggcctacaaccacgccctctccgagctgcccgagaccctggagaccctcctgctgctcaccctgctggccacggtgaccggcggcatcttcctcttcctgatgagcgggcgcggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatggggttcctggagaagaccaagaaggacctcggcctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatggggctgggcaaggggtggcccctctccaagatggacatcggcgtcccgctgctggcgatcgggtgctacagccaggtgaaccccatcaccctcacggccgccctgctgctcctggtggcccactacgcgatcatcggccccggcctgcaggccaaggccacccgcgaggcccagaagcgggccgcggccgggatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacgggccccatctccaccctctgggaggggaacccgggccggttctggaacaccaccatcgcggtgagcatggccaacatcttccgcggctcctacctggccggggccggcctcctcttcagcatcatgaagaacacgaccaacacccggcgcgggaccggcaacatcggcgagacgctgggggagaagtggaagtcccgcctgaacgccctcggcaagagcgagttccagatctacaagaagtccgggatccaggaggtcgaccggaccctggcgaaggagggcatcaagcgcggggagaccgaccaccacgccgtgagccggggctccgccaagctgcgctggttcgtggagcggaacatggtcacccccgagggcaaggtggtggacctcgggtgcggccgcgggggctggagctactactgcgggggcctgaagaacgtccgggaggtgaagggcctgacgaagggcgggcccgggcacgaggagcccatcccgatgtccacctacggctggaacctcgtgcgcctgcagagcggggtcgacgtgttcttcatcccgcccgagaagtgcgacaccctgctctgcgacatcggcgagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacgggggcgccctcgtgcgcaacccgctgagccggaacagcacccacgagatgtactgggtgtccaacgccagcgggaacatcgtctccagcgtgaacatgatctcccgcatgctgatcaaccggttcaccatgcgccacaagaaggccacctacgagcccgacgtggacctcggcagcgggacgcggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcgtccagcatggtcaacggggtggtgcggctgctcaccaagccgtgggacgtcctgcccaccgtgacccagatggccatgacggacaccacccccttcggccagcagcgcgtgttcaaggagaaggtcgacacccgcacgcaggagcccaaggagggcaccaagaagctgatgaagatcaccgccgagtggctctggaaggagctggggaagaagaagaccccgcggatgtgcacgcgcgaggagttcacccggaaggtgcgctccaacgccgccctgggcgcgatcttcaccgacgagaacaagtggaagtccgcccgggaggccgtggaggactcccgcttctgggagctcgtcgacaaggagcggaacctgcacctggaggggaagtgcgagacctgcgtgtacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgtccggggtcgagggcgaggggctccacaagctgggctacatcctgcgcgacgtgagcaagaaggagggcggggccatgtacgccgacgacacggcgggctgggacacccggatcaccctcgaggacctgaagaacgaggagatggtgaccaaccacatggagggggagcacaagaagctggccgaggccatcttcaagctcacgtaccagaacaaggtcgtgcgcgtgcagcggcccacgccccggggcaccgtcatggacatcatcagccggcgcgaccagcgggggtccggccaggtgggcacctacgggctgaacacgttcaccaacatggaggcccagctgatccgccagatggagggcgagggggtgttcaagaacatccagcacctcaccgtcaccgaggaggtggccgtgcagaactggctggcgcgggtcggccgcgagcgcctgagccggatggccatctccggcgacgactgcgtggtgaagcccctcgacgaccgcttcgccaacgccctgacggccctgaacgacatggggaagatccggaaggacatccagcagtgggagccgagcaagggctggaacgactggacccaggtccccttctgctcccaccacttccacgagctcatcatgaaggacgggcgcgtgctggtggtcccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctcgggaagcgggaggaccagtggtgcggctccctgatcgggctgaccagccgcgccacctgggcgaagaacatccaggccgccatcaaccaggtccggtccctcatcggcaacgaggagtacaccgactacatgccgagcatgaagcgcttccggcgcgaggaggaggaggccggggtgctgtggtga

SEQ ID NO: 9573 - RNA, 9876 nt, synthetic construct
  misc_feature 1..9876: note = derived and/or modified CDS sequence (opt1) from DENV-2__EU482662__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacacgatcacctacaagtgccccctcctgcggcagaacgagcccgaggacatcgactgctggtgcaactccaccagcacctgggtgacgtacgggacctgcaccaccacgggcgagcaccggcgcgagaagcggtccgtcgccctggtgccccacgtggggatgggcctcgagacccggaccgagacctggatgagctccgagggggcctggaagcacgcccagcggatcgagacgtggatcctgcgccaccccggcttcaccatcatggcggccatcctggcctacaccatcgggaccacgcacttccagaaggccctcatcttcatcctgctgaccgcggtcgcccccagcatgaccatgcggtgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccggaagtactgcatcgaggcgaagctgacgaacaccaccaccgagtcccgctgcccgacgcagggcgagcccagcctgaacgaggagcaggacaagcggttcgtctgcaagcactccatggtggaccgcggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccgccagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgcggagacccagcacgggacgatcgtcatccgggtgcagtacgagggcgacggctccccctgcaagatccccttcgagatcatggacctggagaagcgccacgtgctcgggcggctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcgcatggccatcctgggggacaccgcctgggacttcggcagcctcggcggggtgttcacctccatcgggaaggcgctccaccaggtgttcggggccatctacggcgccgccttcagcggggtctcctggaccatgaagatcctgatcggcgcgatcatcacgtggatcgggatgaacagccggtccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccgcagcgtcacccggctggagaacctcatgtggaagcagatcacccccgagctgaaccacatcctgtccgagaacgaggtgaagctcacgatcatgaccggcgacatcaaggggatcatgcaggccggcaagcgcagcctgcggccgcagcccaccgagctgaagtactcctggaagacctggggcaaggccaagatgctcagcacggagtcccacaaccagaccttcctgatcgacgggcccgagaccgccgagtgcccgaacaccaaccgcgcctggaacagcctggaggtggaggactacggcttcggggtcttcacgaccaacatctggctcaagctgcgggagaagcaggacgtgttctgcgactccaagctgatgagcgcggccatcaaggacaaccgcgccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccggccgggctactacacccagacggccgggccctggcacctcggcaagctggagatggacttcgacttctgcgaggggaccaccgtcgtggtgaccgaggactgcggcaaccgcggccccagcctgcggacgaccaccgcctccgggaagctcatcaccgagtggtgctgccgcagctgcacgctgcccccgctgcggtaccgcggcgaggacgggtgctggtacggcatggagatccggcccctcaaggagaaggaggagaacctggtcaactccctggtgaccgcggggcacggccagatcgacaacttcagcctcggcgtgctggggatggccctgttcctcgaggagatgctgcgcacccgggtcggcaccaagcacgccatcctgctcgtggccgtgtccttcatgacgctgatcaccgggaacatgagcttccgcgacctgggccgggtcatggtgatggtgggggccaccatgaccgacgacatcggcatgggcgtcacgtacctcgcgctgctggccgccttcaaggtgcgccccaccttcgccgccgggctcctgctgcgcaagctcacctccaaggagctgatgatggcgaccatcggcatcgccctgctcagccagtccacgatccccgagaccatcctggagctgaccgacgccctcgccctggggatgatggtgctgaagatcgtccggaacatggagaagtaccagctcgccgtgaccatcatggcgatcagctgcgtgccgaacgccgtcatcctgcagaacgcctggaaggtgtcctgcacgatcctggccgcggtgagcgtcagccccctcctgctgaccagctcccagcagaaggccgactggatccccctcgccctgaccatcaagggcctgaaccccaccgccatcttcctcacgaccctgagccgcacctccaagaagcggagctggccgctgaacgaggccatcatggcggtgggcatggtgtccatcctcgccagcagcctgctgaagaacgacatccccatgaccgggcccctcgtcgccggcgggctgctgacggtgtgctacgtcctcaccggccgctccgccgacctggagctggagcgggccaccgacgtgaagtgggaggaccaggcggagatcagcgggtccagccccatcctctccatcaccatcagcgaggacggctccatgagcatcaagaacgaggaggaggagcagacgctgaccatcctgatccgcaccggcctcctggtgatctccgggctgttcccggtcagcatccccatcaccgccgccgcctggtacctctgggaggtgaagaagcagcgggccggcgtgctgtgggacgtccccagcccgccgcccgtggggaaggcggagctggaggacggcgcctaccgcatcaagcagaaggggatcctcggctacagccagatcggcgccggggtgtacaaggagggcaccttccacacgatgtggcacgtcacccgcggggccgtgctgatgcaccgcggcaagcggatcgagccctcctgggccgacgtgaagaaggacctgatcagctacgggggcggctggaagctcgagggggagtggaaggagggcgaggaggtccaggtgctggcgctggagcccgggaagaacccccgcgccgtgcagaccaagcccggcctcttcaagaccaacacggggaccatcggcgccgtctccctggacttcagccccggcacctccgggagccccatcgtggaccggaagggcaaggtggtcgggctgtacggcaacggcgtggtgacccgctccggggcctacgtcagcgcgatcgcccagacggagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcaccctcatcctggcgccgacgcgggtggtcgccgccgagatggaggaggccctgcgcgggctccccatccgctaccagacccccgccatccgggcggagcacaccggccgcgagatcgtggacctgatgtgccacgccaccttcacgatgcggctgctctcccccgtgcgcgtcccgaactacaacctgatcatcatggacgaggcccacttcaccgaccccgccagcatcgccgcgcggggctacatctccacccgcgtggagatgggggaggccgccggcatcttcatgaccgccacgccgcccgggagccgggacccgttcccccagtccaacgcgcccatcatcgacgaggagcgcgagatccccgagcggagctggaactccggccacgagtgggtgaccgacttcaaggggaagaccgtctggttcgtgccgagcatcaaggccggcaacgacatcgccgcctgcctgcgcaagaacggcaagaaggtgatccagctctcccggaagaccttcgacagcgagtacgtcaagacgcgcaccaacgactgggacttcgtggtgaccaccgacatctccgagatgggggccaacttcaaggcggagcgggtcatcgacccccgccggtgcatgaagcccgtgatcctgacggacggcgaggagcgcgtgatcctggccgggcccatgccggtcacccacagctccgccgcccagcggcgcggccggatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccatcgacggggagtaccggctccgcggcgaggcccggaagaccttcgtggacctgatgcgccgcggggacctgcccgtctggctcgcctaccgcgtggccgcggagggcatcaactacgccgaccggcgctggtgcttcgacggggtgaagaacaaccagatcctggaggagaacgtcgaggtggagatctggacgaaggagggcgagcggaagaagctgaagccgcgctggctcgacgcccggatctactccgaccccctggccctgaaggagttcaaggagttcgcggccggccgcaagagcctcaccctgaacctgatcaccgagatggggcggctccccaccttcatgacgcagaaggcccgcgacgccctggacaacctggccgtgctccacaccgcggaggccggcgggcgggcctacaaccacgccctgtccgagctgcccgagaccctcgagaccctgctgctcctgacgctgctcgccaccgtcaccggcggcatcttcctgttcctgatgagcgggaagggcgtggggaagatgaccctcggcatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtcgtgatcgccatcctgaccgtcgtggcggccaccatggccaacgagatggggttcctcgagaagacgaagaaggacctgggcctgggcagcatcgccacccaggagccggagtccaacatcctcgacatcgacctgcggcccgccagcgcgtggaccctgtacgccgtggccaccacgttcgtcacccccatgctccgccactccatcgagaacagctccgtgaacgtgagcctgaccgccatcgcgaaccaggccaccgtcctgatggggctcggcaaggggtggcccctgtccaagatggacatcggcgtgccgctgctcgccatcgggtgctacagccaggtgaaccccatcacgctgaccgccgccctgctcctgctgatcgcgcactacgccatcatcggccccggcctccaggccaaggccacccgggaggcccagaagcgcgcggccgccgggatcatgaagaaccccaccgtcgacggcatcacggtgatcgacctggacccgatcccctacgaccccaagttcgagaagcagctgggccaggtgatgctcctgatcctgtgcgtcacccaggtgctcatgatgcggaccacctgggccctgtgcgaggccctgacgctcgcgaccggccccatctccaccctgtgggaggggaacccgggccgcttctggaacaccacgatcgccgtgagcatggccaacatcttccgcggctcctacctggccggggcgggcctcctgttcagcatcatgaagaacaccaccaacacccggcgcgggacgggcaacatcggcgagaccctgggggagaagtggaagtcccggctcaacgccctgggcaagagcgagttccagatctacaagaagtccgggatccaggaggtcgaccgcaccctggccaaggagggcatcaagcgcggggagaccgaccaccacgccgtgagccgcggctccgccaagctccggtggttcgtggagcgcaacatggtcacgcccgagggcaaggtggtggacctggggtgcggccgcgggggctggagctactactgcgggggcctgaagaacgtccgcgaggtgaagggcctcaccaagggcggccccgggcacgaggagcccatcccgatgtccacctacggctggaacctggtgcggctgcagagcggggtcgacgtgttcttcacgccgcccgagaagtgcgacacgctcctgtgcgacatcggcgagagctcccccaacccgaccatcgaggcgggccgcaccctgcgggtgctcagcctggtcgagaactggctgaacaacgacacccagttctgcatcaaggtgctcaacccctacatgccctccgtgatcgagaagatggagaccctgcagcgcaagtacgggggcgccctggtccggaacccgctgagccgcaactccacgcacgagatgtactgggtgagcaacgccaccgggaacatcgtgtccagcgtcaacatgatctcccggatgctcatcaaccgcttcaccatgaagcacaagaaggccacctacgagcccgacgtggacctgggcagcgggacgcggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcgtccagcatggtgaacggggtcgtgcgcctcctgaccaagccgtgggacgtggtccccatggtgacccagatggccatgaccgacacgacccccttcggccagcagcgggtgttcaaggagaaggtcgacacccgcacccaggagcccaaggagggcacgaagaagctgatgaagatcaccgccgagtggctctggaaggagctggggaagaagaagaccccgcggatgtgcacccgcgaggagttcacgcggaaggtgcgctccaacgccgccctgggcgcgatcttcaccgacgagaacaagtggaagtccgcccgggaggccgtggaggactcccgcttctgggagctcgtcgacaaggagcggaacctgcacctggaggggaagtgcgagacctgcgtgtacaacatgatgggcaagcgcgagaagaagctcggggagttcggcaaggccaagggcagccgggcgatctggtacatgtggctgggggcccgcttcctggagttcgaggccctcggcttcctgaacgaggaccactggttcagccgggagaactccctgagcggggtggagggcgaggggctccacaagctgggctacatcctgcgcgacgtctccaagaaggagggcggggccatgtacgccgacgacaccgcgggctgggacacgcggatcaccctcgaggacctgaagaacgaggagatggtgaccaaccacatggagggggagcacaagcgcctggccgaggccatcttcaagctcacctaccagaacaaggtggtccgggtgcagcgccccacgccccggggcaccgtcatggacatcatcagccgccgggaccagcgcgggtccggccaggtgggcacctacgggctgaacaccttcacgaacatggaggcccagctgatccgccagatggagggcgaggggatcttcaagagcatccagcacctcaccgtgaccgaggagatcgccgtccagaactggctggcgcgggtgggccgcgagcggctgtcccgcatggccatcagcggcgacgactgcgtggtcaagcccctcgacgaccggttcgcctccgccctgaccgccctgaacgacatggggaaggtgcgcaaggacatccagcagtgggagccgagcaagggctggaacgactggacccaggtgcccttctgctcccaccacttccacgagctcatcatgaaggacgggcgggtcctggtggtgccctgccgcaaccaggacgagctgatcggccgggcgcgcatcagccagggggccggctggtccctcaaggagaccgcctgcctgggcaagagctacgcccagatgtggtccctgatgtacttccaccggcgcgacctccggctggccgcgaacgccatctgcagcgccgtcccctcccactgggtgccgaccagccgcaccacctggagcatccacgccaagcacgagtggatgacgaccgaggacatgctgaccgtgtggaaccgggtctggatccaggagaacccctggatggaggacaagacccccgtggagtcctgggaggaggtgccctacctcgggaagcgcgaggaccagtggtgcggcagcctgatcgggctgacgtcccgggcgacctgggccaagaacatccagaccgccatcaaccaggtccgcagcctcatcggcaacgaggagtacaccgactacatgccgtccatgaagcggttccgccgcgaggaggaggaggccggggtgctgtggtga

SEQ ID NO: 9574 - RNA, 9876 nt, synthetic construct
  misc_feature 1..9876: note = derived and/or modified CDS sequence (opt1) from DENV-2__EU482663__SS-prME
  source 1..9876: mol_type = other RNA
agcgccgggatgatcatcatgctgatccccaccgtgatggccttccacctcaccacccggaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgtgttctgcgactccaagctgatgagcgccgccatcaaggacaaccgggccgtgcacgcggacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgccggcccctggcacctggggaagctggagatggacttcgacttctgcgacggcaccaccgtcatcgtgacggaggactgcgggaaccggggcccctccctccgcaccaccaccgcgagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgccatcctcctggtggcggtgtccttcgtcaccctgatcaccggcaacatgagcttcaaggacctcgggcgggtggtggtcatggtgggcgccaccatggccgacgacatcgggatgggcgtgacgtacctggccctgctcgccgcgttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggccctgggcatgatggtcctcaagatcgtgcgcaacatggagaagtaccagctggcggtcacgatcatggccatcctgtgcgtgccgaacgccgtgatcctccagaacgcctggaaggtcagctgcaccatcctggccgtggtgtccgtcagccccctgctcctgacctccagccagcagaagaccgactggatccccctggcgctcacgatcaaggggctgaaccccaccgccatcttcctgaccaccctctcccgcacgaacaagaagcggagctggccgctgaacgaggccatcatggccgtgggcatggtgtccatcctggcgagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggccgagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgcggccgcctggtacctgtgggaggtgaagaagcagcgggccggggtcctctgggacgtgcccagcccgccgcccatgggcaaggccgagctggaggacggggcgtaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgccctggagcccggcaagaacccccgggcggtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcccagaccgagaagtccatcgaggacaaccccgagatcgaggacgacatcttccggaagcgccggctgaccatcatggacctgcaccccggggcgggcaagacgaagcgctacctccccgccatcgtccgggaggccatcaagcgcgggctgcggaccctgatcctcgccccgacccgcgtggtggcggccgagatggaggaggccctgcggggcctgcccatccgctaccagacccccgccatccgggccgagcacacggggcgcgagatcgtcgacctcatgtgccacgcgaccttcaccatgcgcctgctgagccccgtgcgggtgccgaactacaacctcatcatcatggacgaggcccacttcaccgaccccgcctccatcgccgcccgcggctacatcagcacgcgggtcgagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggccgggaacgacatcgcggcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggccgagcgcgtgatcgacccccggcgctgcatgaagcccgtcatcctcaccgacggggaggagcgggtgatcctggcgggccccatgccggtgacccacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgcgagaaggtcgacgcgatcgacggcgagtaccggctgcgcggggaggcccgcaagaccttcgtggacctcatgcggcgcggcgacctgcccgtgtggctggcctacaaggtcgccgccgaggggatcaactacgcggaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgccggccgcaagagcctgaccctcaacctgatcacggagatgggccggctgcccaccttcatgacccagaagacccgcgacgcgctcgacaacctggccgtgctgcacacggccgaggccgggggccgggcgtacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacgtacgtggtgatcgccatcctgaccgtcgtggccgccaccatggcgaacgagatgggcttcctggagaagaccaagaaggacttcgggctcggctccatcgccacgcagcagccggagagcaacatcctggacatcgacctgcgccccgcctccgcctggaccctctacgccgtggcgaccaccttcgtcacgcccatgctgcggcacagcatcgagaacagctccgtgaacgtgagcctgaccgccatcgccaaccaggccaccgtcctcatgggcctggggaagggctggcccctgtccaagatggacatcggggtgccgctcctggccatcggctgctacagccaggtgaaccccatcaccctgacggcggccctcctgctgctcgtcgcccactacgccatcatcgggcccggcctgcaggcgaaggccacccgcgaggcccagaagcgggccgccgcgggcatcatgaagaaccccaccgtggacgggatcaccgtgatcgacctggacccgatcccctacgaccccaagttcgagaagcagctcggccaggtcatgctgctgatcctctgcgtgacccaggtgctgatgatgcgcaccacctgggccctgtgcgaggccctcaccctggccacggggcccatctccaccctgtgggagggcaacccggggcggttctggaacaccaccatcgccgtcagcatggcgaacatcttccgcggctcctacctcgccggcgccgggctgctgttcagcatcatgaagaacacgaccaacacccggcgcggcaccgggaacatcggcgagacgctcggcgagaagtggaagtcccgcctgaacgccctggggaagtccgagttccagatctacaagaagtccggcatccaggaggtggaccggaccctcgccaaggaggggatcaagcgcggcgagaccgaccaccacgcggtgagccgggggtccgccaagctgcgctggttcgtcgagcggaacatggtgacccccgagggcaaggtggtcgacctgggctgcgggcgcggcgggtggagctactactgcggcgggctccggaacgtgcgcgaggtgaagggcctgacgaagggcgggcccggccacgaggagcccatcccgatgtccacctacgggtggaacctggtccggctccagagcggcgtggacgtgttcttcatcccgcccgagaagtgcgacaccctgctgtgcgacatcggggagtccagccccaacccgaccgtcgaggccggccgcacgctccgggtgctgaacctggtggagaactggctcaacaacaacacccagttctgcatcaaggtcctgaacccctacatgccctccgtgatcgagaagatggaggccctgcagcgcaagtacggcggggcgctggtgcggaacccgctcagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctggggagcggcacgcgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtggtccgcctgctgaccaagccgtgggacgtgctccccaccgtgacccagatggcgatgacggacaccacccccttcgggcagcagcgcgtcttcaaggagaaggtggacacccggacgcaggagcccaaggagggcaccaagaagctgatgaagatcaccgccgagtggctgtggaaggagctcggcaagaagaagaccccgcgcatgtgcacgcgggaggagttcacccgcaaggtgcggtccaacgccgccctgggggccatcttcaccgacgagaacaagtggaagtccgcgcgcgaggccgtcgaggactcccggttctgggagctggtggacaaggagcgcaacctccacctggagggcaagtgcgagacctgcgtctacaacatgatggggaagcgggagaagaagctgggcgagttcgggaaggccaagggcagccgcgccatctggtacatgtggctcggcgcccggttcctggagttcgaggcgctggggttcctcaacgaggaccactggttctcccgcgagaacagcctgtccggcgtggagggggagggcctgcacaagctcgggtacatcctgcgggacgtgagcaagaaggagggcggcgccatgtacgccgacgacacggccgggtgggacacccgcatcaccctggaggacctcaagaacgaggagatggtcaccaaccacatggagggcgagcacaagaagctggcggaggccatcttcaagctgacgtaccagaacaaggtggtgcgggtccagcgccccacgccccgggggaccgtgatggacatcatcagccgccgggaccagcgcggctccggccaggtggggacctacggcctcaacacgttcaccaacatggaggcccagctgatccggcagatggagggggagggcgtcttcaagaacatccagcacctgaccgtgaccgaggaggtggccgtccagaactggctcgcccgcgtggggcgcgagcggctgagccgcatggcgatctccggcgacgactgcgtggtcaagcccctggacgaccggttcgccaacgccctcacggccctgaacgacatgggcaagatccgcaaggacatccagcagtgggagccgagcaaggggtggaacgactggacccaggtgcccttctgctcccaccacttccacgagctgatcatgaaggacggccgggtgctcgtcgtgccctgccgcaaccaggacgagctgatcgggcgggcccgcatcagccagggcgcggggtggtccctgcgggagaccgcctgcctcggcaagagctacgcccagatgtggtccctgatgtacttccaccgccgggacctgcgcctcgccgccaacgcgatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctgggcaagcgcgaggaccagtggtgcgggtccctcatcggcctgaccagccgggccacctgggccaagaacatccaggcggccatcaaccaggtgcgctccctgatcgggaacgaggagtacatcgactacatgccgagcatgaagcggttccgccgcgaggaggaggaggccggcgtgctctggtga

SEQ ID NO: 9575 - RNA, 9876 nt, synthetic construct
  misc_feature 1..9876: note = derived and/or modified CDS sequence (opt1) from DENV-2__EU482664__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacacgatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacgtggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgcggagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtgttcggggccatctacggcgccgccttcagcggggtctcctggaccatgaagatcctgatcggcgcgatcatcacgtggatcgggatgaacagccgctccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccgcccgggctactacacccagacggccgggccctggcacctcggcaagctggagatggacttcgacttctgcgaggggaccaccgtcgtggtgaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtcaactccctggtgaccgcggggcacggccagatcgacaacttcagcctcggcgtgctggggatggccctgttcctcgaggagatgctgcggacccgcgtcggcaccaagcacgccatcctgctcgtggccgtgtccttcgtcacgctgatcaccgggaacatgagcttccgggacctgggccgcgtgatggtgatggtcggggccaccatgaccgacgacatcggcatgggcgtgacgtacctcgcgctgctggccgccttcaaggtgcgccccaccttcgccgccgggctcctgctgcggaagctcacctccaaggagctgatgatggcgaccatcggcatcgccctgctcagccagtccacgatccccgagaccatcctggagctgaccgacgccctcgccctggggatgatggtcctgaagatcgtgcgcaacatggagaagtaccagctcgccgtgaccatcatggcgatcagctgcgtcccgaacgccgtgatcctgcagaacgcctggaaggtgtcctgcacgatcctggccgcggtcagcgtgagccccctcctgctgaccagctcccagcagaaggccgactggatccccctcgccctgaccatcaagggcctgaaccccaccgccatcttcctcacgaccctgagccggacctccaagaagcgcagctggccgctgaacgaggccatcatggcggtgggcatggtctccatcctcgccagcagcctgctgaagaacgacatccccatgaccgggcccctcgtggccggcgggctgctgacggtctgctacgtgctcaccggccggtccgccgacctggagctggagcgcgccaccgacgtgaagtgggaggaccaggcggagatcagcgggtccagccccatcctctccatcaccatcagcgaggacggctccatgagcatcaagaacgaggaggaggagcagacgctgaccatcctgatccggaccggcctcctggtcatctccgggctgttcccggtgagcatccccatcaccgccgccgcctggtacctctgggaggtgaagaagcagcgcgccggcgtcctgtgggacgtgcccagcccgccgcccgtggggaaggcggagctggaggacggcgcctaccggatcaagcagaaggggatcctcggctacagccagatcggcgccggggtctacaaggagggcaccttccacacgatgtggcacgtgacccgcggggccgtgctgatgcaccggggcaagcgcatcgagccctcctgggccgacgtcaagaaggacctgatcagctacgggggcggctggaagctcgagggggagtggaaggagggcgaggaggtccaggtgctggcgctggagcccgggaagaacccccgggccgtccagaccaagcccggcctcttcaagaccaacacggggaccatcggcgccgtgtccctggacttcagccccggcacctccgggagccccatcgtggaccgcaagggcaaggtcgtggggctgtacggcaacggcgtggtcacccggtccggggcctacgtgagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcggaccctcatcctggcgccgacgcgcgtcgtggccgccgagatggaggaggccctgcgcgggctccccatccggtaccagacccccgccatccgcgcggagcacaccggccgggagatcgtggacctgatgtgccacgccaccttcacgatgcgcctgctctcccccgtccgggtgccgaactacaacctgatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagtccaacgcgcccatcatcgacgaggagcgggagatccccgagcgcagctggaactccggccacgagtgggtcaccgacttcaaggggaagaccgtgtggttcgtgccgagcatcaaggccggcaacgacatcgccgcctgcctgcggaagaacggcaagaaggtcatccagctctcccgcaagaccttcgacagcgagtacgtgaagacgcggaccaacgactgggacttcgtggtcaccaccgacatctccgagatgggggccaacttcaaggcggagcgcgtgatcgacccccggcgctgcatgaagcccgtgatcctgacggacggcgaggagcgggtcatcctggccgggcccatgccggtgacccacagctccgccgcccagcgccggggccgcatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagaccttcgtcgacctgatgcggcgcggggacctgcccgtgtggctcgcctaccgggtggccgcggagggcatcaactacgccgaccgccggtggtgcttcgacggggtcaagaacaaccagatcctggaggagaacgtggaggtggagatctggacgaaggagggcgagcgcaagaagctgaagccgcggtggctcgacgcccgcatctactccgaccccctggccctgaaggagttcaaggagttcgcggccggccggaagtccctcaccctgaacctgatcaccgagatggggcgcctccccaccttcatgacgcagaaggcccgggacgccctggacaacctggccgtcctccacaccgcggaggccggcgggcgcgcctacaaccacgccctgtccgagctgcccgagaccctcgagaccctgctgctcctgacgctgctcgccaccgtgaccggcggcatcttcctgttcctgatgagcgggaagggcgtggggaagatgaccctcggcatgtgctgcatcatcaccgcgtccatcctgctgtggtacgcccagatccagccgcactggatcgccgccagcatcatcctcgagttcttcctgatcgtcctgctcatccccgagcccgagaagcagcggacgccccaggacaaccagctgacctacgtggtcatcgccatcctgaccgtggtggcggccaccatggccaacgagatggggttcctcgagaagacgaagaaggacctgggcctgggcagcgtcgccacccaggagccggagtccaacatcctcgacatcgacctgcgccccgccagcgcgtggaccctgtacgccgtggccaccacgttcgtgacccccatgctccggcactccatcgagaacagctccgtcaacgtgagcctgaccgccatcgcgaaccaggccaccgtgctgatggggctcggcaaggggtggcccctgtccaagatggacatcggcgtcccgctgctcgccatcgggtgctacagccaggtgaaccccatcacgctgaccgccgccctgctcctgctgatcgcgcactacgccatcatcggccccggcctccaggccaaggccacccgcgaggcccagaagcgggcggccgccgggatcatgaagaaccccaccgtggacggcatcacggtcatcgacctggacccgatcccctacgaccccaagttcgagaagcagctgggccaggtgatgctcctgatcctgtgcgtgacccaggtcctcatgatgcgcaccacctgggccctgtgcgaggccctgacgctcgcgaccggccccatctccaccctgtgggaggggaacccgggccgcttctggaacaccacgatcgccgtgagcatggccaacatcttccggggctcctacctggccggggcgggcctcctgttcagcatcatgaagaacaccaccaacacccgccgggggacgggcaacatcggcgagaccctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtcagccggggctccgccaagctccgctggttcgtggagcggaacatggtgacgcccgagggcaaggtcgtggacctggggtgcggccgcgggggctggagctactactgcgggggcctgaagaacgtgcgggaggtcaagggcctcaccaagggcggccccgggcacgaggagcccatcccgatgtccacctacggctggaacctggtgcgcctgcagagcggggtggacgtcttcttcacgccgcccgagaagtgcgacacgctcctgtgcgacatcggcgagagctcccccaacccgaccatcgaggcgggccggaccctgcgcgtgctcagcctggtggagaactggctgaacaacgacacccagttctgcatcaaggtcctcaacccctacatgccctccgtgatcgagaagatggagaccctgcagcggaagtacgggggcgccctggtgcgcaacccgctgagccggaactccacgcacgagatgtactgggtcagcaacgccaccgggaacatcgtgtccagcgtgaacatgatctcccgcatgctcatcaaccggttcaccatgaagcacaagaaggccacctacgagcccgacgtcgacctgggcagcgggacgcgcaacatcggcatcgagtccgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcgtccagcatggtgaacggggtggtccggctcctgaccaagccgtgggacgtggtgcccatggtcacccagatggccatgaccgacacgacccccttcggccagcagcgcgtgttcaaggagaaggtggacacccggacccaggagcccaaggagggcacgaagaagctgatgaagatcaccgccgagtggctctggaaggagctggggaagaagaagaccccgcgcatgtgcacccgggaggagttcacgcgcaaggtccggtccaacgccgccctgggcgcgatcttcaccgacgagaacaagtggaagtccgcccgcgaggccgtggaggactcccggttctgggagctcgtggacaaggagcgcaacctgcacctggaggggaagtgcgagacctgcgtctacaacatgatgggcaagcgggagaagaagctcggggagttcggcaaggccaagggcagccgcgcgatctggtacatgtggctgggggcccggttcctggagttcgaggccctcggcttcctgaacgaggaccactggttcagccgcgagaactccctgagcggggtggagggcgaggggctccacaagctgggctacatcctgcgggacgtgtccaagaaggagggcggggccatgtacgccgacgacaccgcgggctgggacacgcgcatcaccctcgaggacctgaagaacgaggagatggtcaccaaccacatggagggggagcacaagcggctggccgaggccatcttcaagctcacctaccagaacaaggtggtccgcgtgcagcggcccacgccccgcggcaccgtgatggacatcatcagccggcgcgaccagcgcgggtccggccaggtcggcacctacgggctgaacaccttcacgaacatggaggcccagctgatccggcagatggagggcgaggggatcttcaagagcatccagcacctcaccgtgaccgaggagatcgccgtgcagaactggctggcgcgcgtcggccgggagcgcctgtcccggatggccatcagcggcgacgactgcgtggtgaagcccctcgacgaccgcttcgcctccgccctgaccgccctgaacgacatggggaaggtccggaaggacatccagcagtgggagccgagcaagggctggaacgactggacccaggtgcccttctgctcccaccacttccacgagctcatcatgaaggacgggcgcgtgctggtcgtgccctgccggaaccaggacgagctgatcggccgcgcgcggatcagccagggggccggctggtccctcaaggagaccgcctgcctgggcaagagctacgcccagatgtggtccctgatgtacttccaccgccgggacctccgcctggccgcgaacgccatctgcagcgccgtgccctcccactgggtcccgaccagccggaccacctggagcatccacgccaagcacgagtggatgacgaccgaggacatgctgaccgtgtggaaccgcgtgtggatccaggagaacccctggatggaggacaagacccccgtcgagtcctgggaggaggtgccctacctcgggaagcgggaggaccagtggtgcggcagcctgatcgggctgacgtcccgcgcgacctgggccaagaacatccagaccgccatcaaccaggtgcggagcctcatcggcaacgaggagtacaccgactacatgccgtccatgaagcgcttccgccgggaggaggaggaggccggggtcctgtggtga

SEQ ID NO: 9576 - RNA, 9876 nt, synthetic construct
  misc_feature 1..9876: note = derived and/or modified CDS sequence (opt1) from DENV-2__EU482665__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacttcgggctcggctccatcgccacgcagcagccggagagcaacatcctggacatcgacctgcgccccgcctccgcctggaccctctacgcggtggccaccaccttcgtgacgcccatgctgcggcacagcatcgagaacagctccgtcaacgtgagcctgaccgccatcgccaaccaggccaccgtgctcatgggcctggggaagggctggcccctgtccaagatggacatcggggtcccgctcctggcgatcggctgctacagccaggtgaaccccatcaccctgacggccgccctcctgctgctcgtggcccactacgcgatcatcgggcccggcctgcaggccaaggccacccgcgaggcccagaagcgggccgcggccggcatcatgaagaaccccaccgtcgacgggatcaccgtgatcgacctggacccgatcccctacgaccccaagttcgagaagcagctcggccaggtgatgctgctgatcctctgcgtcacccaggtgctgatgatgcgcaccacctgggccctgtgcgaggccctcaccctggccacggggcccatctccaccctgtgggagggcaacccggggcggttctggaacaccaccatcgcggtgagcatggccaacatcttccgcggctcctacctcgccggcgccgggctgctgttcagcatcatgaagaacacgaccaacacccggcgcggcaccgggaacatcggcgagacgctcggcgagaagtggaagtcccgcctgaacgccctggggaagtccgagttccagatctacaagaagtccggcatccaggaggtcgaccggaccctcgcgaaggaggggatcaagcgcggcgagaccgaccaccacgccgtgagccgggggtccgccaagctgcgctggttcgtggagcggaacatggtcacccccgagggcaaggtggtggacctgggctgcgggcgcggcgggtggagctactactgcggcgggctcaagaacgtccgggaggtgaagggcctgacgaagggcgggcccggccacgaggagcccatcccgatgtccacctacgggtggaacctggtgcgcctccagagcggcgtcgacgtgttcttcatcccgcccgagaagtgcgacaccctgctgtgcgacatcggggagtccagccccaacccgaccgtggaggccggccggacgctccgcgtcctgaacctggtggagaactggctcaacaacaacacccagttctgcatcaaggtgctgaacccctacatgccctccgtcatcgagaagatggaggcgctgcagcggaagtacggcggggccctggtgcgcaacccgctcagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctggggagcggcacgcggaacatcgggatcgagtccgagatccccaacctcgacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcggctgctgaccaagccgtgggacgtcctccccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctgtggaaggagctcggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctggtcgacaaggagcggaacctccacctggagggcaagtgcgagacctgcgtgtacaacatgatggggaagcgcgagaagaagctgggcgagttcgggaaggccaagggcagccgggccatctggtacatgtggctcggcgcgcgcttcctggagttcgaggccctggggttcctcaacgaggaccactggttctcccgggagaacagcctgtccggcgtcgagggggagggcctgcacaagctcgggtacatcctgcgcgacgtgagcaagaaggagggcggcgccatgtacgccgacgacacggcggggtgggacacccggatcaccctggaggacctcaagaacgaggagatggtgaccaaccacatggagggcgagcacaagaagctggccgaggccatcttcaagctgacgtaccagaacaaggtcgtgcgcgtgcagcggcccacgccccgggggaccgtcatggacatcatcagccggcgcgaccagcggggctccggccaggtggggacctacggcctcaacacgttcaccaacatggaggcccagctgatccgccagatggagggggagggcgtgttcaagaacatccagcacctgaccgtcaccgaggaggtggccgtgcagaactggctcgcgcgggtcgggcgcgagcgcctgagccggatggccatctccggcgacgactgcgtggtgaagcccctggacgaccgcttcgccaacgccctcacggccctgaacgacatgggcaagatccggaaggacatccagcagtgggagccgagcaaggggtggaacgactggacccaggtccccttctgctcccaccacttccacgagctgatcatgaaggacggccgcgtgctcgtggtcccctgccggaaccaggacgagctgatcgggcgcgcgcggatcagccagggcgccgggtggtccctgcgcgagaccgcctgcctcggcaagagctacgcccagatgtggtccctgatgtacttccaccggcgcgacctgcggctcgccgcgaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctgggcaagcgggaggaccagtggtgcgggtccctcatcggcctgaccagccgcgccacctgggcgaagaacatccaggccgccatcaaccaggtccggtccctgatcgggaacgaggagtacaccgactacatgccgagcatgaagcgcttccggcgcgaggaggaggaggccggcgtgctctggtga

SEQ ID NO: 9577 - RNA, 9876 nt, synthetic construct
  misc_feature 1..9876: note = derived and/or modified CDS sequence (opt1) from DENV-2__EU482666__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacacgatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacgtggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgcggagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtgttcggggccatctacggcgccgccttcagcggggtctcctggaccatgaagatcctgatcggcgcgatcatcacgtggatcgggatgaacagccgctccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccgcccgggctaccacacccagacggccgggccctggcacctcggcaagctggagatggacttcgacttctgcgaggggaccaccgtcgtggtgaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtcaactccctggtgaccgcggggcacggccagatcgacaacttcagcctcggcgtgctggggatggccctgttcctcgaggagatgctgcggacccgcgtcggcaccaagcacgccatcctgctcgtggccgtgtccttcatgacgctgatcaccgggaacatgagcttccgggacctgggccgcgtcatggtgatggtgggggccaccatgaccgacgacatcggcatgggcgtcacgtacctcgcgctgctggccgccttcaaggtgcgccccaccttcgccgccgggctcctgctgcggaagctcacctccaaggagctgatgatggcgaccatcggcatcgccctgctcagccagtccacgatccccgagaccatcctggagctgaccgacgccctcgccctggggatgatggtgctgaagatcatgcgcaacatggagaagtaccagctcgccgtcaccatcatggcgatcagctgcgtgccgaacgccgtgatcctgcagaacgcctggaaggtctcctgcacgatcctggccgcggtgagcgtgagccccctcctgctgaccagctcccagcagaaggccgactggatccccctcgccctgaccatcaagggcctgaaccccaccgccatcttcctcacgaccctgagccggacctccaagaagcgcagctggccgctgaacgaggccatcatggcggtcggcatggtgtccatcctcgccagcagcctgctgaagaacgacatccccatgaccgggcccctcgtggccggcgggctgctgacggtctgctacgtgctcaccggccggtccgccgacctggagctggagcgcgccaccgacgtcaagtgggaggaccaggcggagatcagcgggtccagccccatcctctccatcaccatcagcgaggacggctccatgagcatcaagaacgaggaggaggagcagacgctgaccatcctgatccggaccggcctcctggtgatctccgggctgttcccggtgagcatccccatcaccgccgccgcctggtacctctgggaggtcaagaagcagcgcgccggcgtgctgtgggacgtgcccagcccgccgcccgtcgggaaggcggagctggaggacggcgcctaccggatcaagcagaaggggatcctcggctacagccagatcggcgccggggtgtacaaggagggcaccttccacacgatgtggcacgtgacccgcggggccgtcctgatgcaccggggcaagcgcatcgagccctcctgggccgacgtgaagaaggacctgatcagctacgggggcggctggaagctcgagggggagtggaaggagggcgaggaggtgcaggtcctggcgctggagcccgggaagaacccccgggccgtgcagaccaagcccggcctcttcaagaccaacacggggaccatcggcgccgtgtccctggacttcagccccggcacctccgggagccccatcgtcgaccgcaagggcaaggtggtggggctgtacggcaacggcgtcgtgacccggtccggggcctacgtgagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtccgggaggccatcaagcgcggcctgcggaccctcatcctggcgccgacgcgcgtggtggccgccgagatggaggaggccctgcgcgggctccccatccggtaccagacccccgccatccgcgcggagcacaccggccgggagatcgtcgacctgatgtgccacgccaccttcacgatgcgcctgctctcccccgtgcgggtgccgaactacaacctgatcatcatggacgaggcccacttcaccgaccccgccagcatcgccgcgcgcggctacatctccacccgggtcgagatgggggaggccgccggcatcttcatgaccgccacgccgcccgggagccgcgacccgttcccccagtccaacgcgcccatcatcgacgaggagcgggagatccccgagcgcagctggaactccggccacgagtgggtgaccgacttcaaggggaagaccgtgtggttcgtcccgagcatcaaggccggcaacgacatcgccgcctgcctgcggaagaacggcaagaaggtgatccagctctcccgcaagaccttcgacagcgagtacgtgaagacgcggaccaacgactgggacttcgtcgtgaccaccgacatctccgagatgggggccaacttcaaggcggagcgcgtgatcgacccccggcgctgcatgaagcccgtcatcctgacggacggcgaggagcgggtgatcctggccgggcccatgccggtgacccacagctccgccgcccagcgccggggccgcatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtcgacgccatcgacggggagtaccgcctccggggcgaggcccgcaagaccttcgtggacctgatgcggcgcggggacctgcccgtgtggctcgcctaccgggtcgccgcggagggcatcaactacgccgaccgccggtggtgcttcgacggggtgaagaacaaccagatcctggaggagaacgtggaggtcgagatctggacgaaggagggcgagcgcaagaagctgaagccgcggtggctcgacgcccgcatctactccgaccccctggccctgaaggagttcaaggagttcgcggccggccggaagtccctcaccctgaacctgatcaccgagatggggcgcctccccaccttcatgacgcagaaggcccgggacgccctggacaacctggccgtgctccacaccgcggaggccggcgggcgcgcctacaaccacgccctgtccgagctgcccgagaccctcgagaccctgctgctcctgacgctgctcgccaccgtgaccggcggcatcttcctgttcctgatgagcgggaagggcgtcgggaagatgaccctcggcatgtgctgcatcatcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgccatcctgaccgtggtcgcggccaccatggccaacgagatggggttcctcgagaagacgaagaaggacctgggcctgggcagcatcgccacccaggagccggagtccaacatcctcgacatcgacctgcgccccgccagcgcgtggaccctgtacgccgtggccaccacgttcgtgacccccatgctccggcactccatcgagaacagctccgtcaacgtgagcctgaccgccatcgcgaaccaggccaccgtgctgatggggctcggcaaggggtggcccctgtccaagatggacatcggcgtcccgctgctcgccatcgggtgctacagccaggtgaaccccatcacgctgaccgccgccctgctcctgctgatcgcgcactacgccatcatcggccccggcctccaggccaaggccacccgcgaggcccagaagcgggcggccgccgggatcatgaagaaccccaccgtggacggcatcacggtcatcgacctggacccgatcccctacgaccccaagttcgagaagcagctgggccaggtgatgctcctgatcctgtgcgtgacccaggtcctcatgatgcgcaccacctgggccctgtgcgaggccctgacgctcgcgaccggccccatctccaccctgtgggaggggaacccgggccgcttctggaacaccacgatcgccgtgagcatggccaacatcttccggggctcctacctggccggggcgggcctcctgttcagcatcatgaagaacaccaccaacacccgccgggggacgggcaacatcggcgagaccctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtcagccggggctccgccaagctccgctggttcgtggagcggaacatggtgacgcccgagggcaaggtcgtggacctggggtgcggccgcgggggctggagctactactgcgggggcctgaagaacgtgcgggaggtcaagggcctcaccaagggcggccccgggcacgaggagcccatcccgatgtccacctacggctggaacctggtgcgcctgcagagcggggtggacgtcttcttcacgccgcccgagaagtgcgacacgctcctgtgcgacatcggcgagagctcccccaacccgaccatcgaggcgggccggaccctgcgcgtgctcagcctggtggagaactggctgaacaacgacacccagttctgcatcaaggtcctcaacccctacatgccctccgtgatcgagaagatggagaccctgcagcggaagtacgggggcgccctggtgcgcaacccgctgagccggaactccacgcacgagatgtactgggtcagcaacgccaccgggaacatcgtgtccagcgtgaacatgatctcccgcatgctcatcaaccggttcaccatgaagcacaagaaggccacctacgagcccgacgtcgacctgggcagcgggacgcgcaacatcggcatcgagtccgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcgtccagcatggtgaacggggtggtccggctcctgaccaagccgtgggacgtggtgcccatggtcacccagatggccatgaccgacacgacccccttcggccagcagcgcgtgttcaaggagaaggtggacacccggacccaggagcccaaggagggcacgaagaagctgatgaagatcaccgccgagtggctctggaaggagctggggaagaagaagaccccgcgcatgtgcacccgggaggagttcacgcgcaaggtccggtccaacgccgccctgggcgcgatcttcaccgacgagaacaagtggaagtccgcccgcgaggccgtggaggactcccggttctgggagctcgtggacaaggagcgcaacctgcacctggaggggaagtgcgagacctgcgtctacaacatgatgggcaagcgggagaagaagctcggggagttcggcaaggccaagggcagccgcgcgatctggtacatgtggctgggggcccggttcctggagttcgaggccctcggcttcctgaacgaggaccactggttcagccgcgagaactccctgagcggggtggagggcgaggggctccacaagctgggctacatcctgcgggacgtgtccaagaaggagggcggggccatgtacgccgacgacaccgcgggctgggacacgcgcatcaccctcgaggacctgaagaacgaggagatggtcaccaaccacatggagggggagcacaagcggctggccgaggccatcttcaagctcacctaccagaacaaggtggtgcgcgtccagcggcccacgccccgcggcaccgtgatggacatcatcagccggcgcgaccagcgcgggtccggccaggtcggcacctacgggctgaacaccttcacgaacatggaggcccagctgatccggcagatggagggcgaggggatcttcaagagcatccagcacctcaccgtgaccgaggagatcgccgtgcagaactggctggcgcgcgtcggccgggagcgcctgtcccggatggccatcagcggcgacgactgcgtggtgaagcccctcgacgaccgcttcgcctccgccctgaccgccctgaacgacatggggaaggtccggaaggacatccagcagtgggagccgagcaagggctggaacgactggacccaggtgcccttctgctcccaccacttccacgagctcatcatgaaggacgggcgcgtgctggtcgtgccctgccggaaccaggacgagctgatcggccgcgcgcggatcagccagggggccggctggtccctcaaggagaccgcctgcctgggcaagagctacgcccagatgtggtccctgatgtacttccaccgccgggacctccgcctggccgcgaacgccatctgcagcgccgtgccctcccactgggtcccgaccagccggaccacctggagcatccacgccaagcacgagtggatgacgaccgaggacatgctgaccgtgtggaaccgcgtgtggatccaggagaacccctggatggaggacaagacccccgtcgagtcctgggaggaggtgccctacctcgggaagcgggaggaccagtggtgcggcagcctgatcgggctgacgtcccgcgcgacctgggccaagaacatccagaccgccatcaaccaggtgcggagcctcatcggcaacgaggagtacaccgactacatgccgtccatgaagcgcttccgccgggaggaggaggaggccggggtcctgtggtga

SEQ ID NO: 9578 - RNA, 9876 nt, synthetic construct
  misc_feature 1..9876: note = derived and/or modified CDS sequence (opt1) from DENV-2__EU482667__SS-prME
  source 1..9876: mol_type = other RNA
agcgcggggatgatcatcatgctgatccccaccgtgatggccttccacctcaccacccggaacggggagccccacatgatcgtggggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggaggccctggtcaccttcaagaacccccacgcgaagaagcaggacgtggtcgtgctcggcagccaggagggggccatgcacaccgccctgacgggcgccaccgagatccagatgagctccgggaacctcctcttcaccggccacctgaagtgccggctgcgcatggacaagctccagctgaagggcatgagctactccatgtgcaccgggaagttcaaggtggtcaaggagatcgccgagacgcagcacggcaccatcgtgatcaaggtgcagtacgagggggacggcagcccctgcaagatccccttcgagatcatggacctggagaagcggtacgtcctcggccgcctgatcaccgtgaacccgatcgtgaccgagaaggactcccccgtcaacatcgaggcggagccgcccttcggggacagctacatcatcatcggcgtggagccggggcagctgaagctcaactggttcaagaagggctccagcatcgggcagatgttcgagacgaccatgcggggcgccaagcgcatggccatcctgggcgacaccgcctgggacttcgggtccctgggcggggtgttcaccagcatcggcaaggccctccaccaggtcttcggggcgatctacggcgccgccttctccggcgtgagctggacgatgaagatcctgatcggggtgatcatcacctggatcggcatgaactcccgcagcacctccctgagcgtctccctggtgctcgtggggatcgtcaccctgtacctgggcgtgatggtgcaggccgacagcgggtgcgtcgtgtcctggaagaacaaggagctcaagtgcggcagcggcatcttcatcacggacaacgtgcacacctggaccgagcagtacaagttccagcccgagagcccctccaagctggcgagcgccatccagaaggcccaggaggaggggatctgcggcatccggtccgtcacccgcctggagaacctcatgtggaagcagatcacgcccgagctgaaccacatcctggccgagaacgaggtgaagctcaccatcatgaccggggacatcaagggcatcatgcaggccgggaagcggagcctgcgcccgcagcccaccgagctgaagtactcctggaagacgtggggcaaggcgaagatgctcagcaccgagtcctacaaccagaccttcctgatcgacggccccgagaccgccgagtgcccgaacacgaaccgggcctggaacagcctggaggtggaggactacgggttcggcgtcttcaccaccaacatctggctcaagctgaaggagaagcaggacgtgttctgcgactccaagctgatgagcgccgccatcaaggacaaccgcgcggtgcacgccgacatggggtactggatcgagtccgccctcaacgacacctggaagatcgagaaggccagcttcatcgaggtcaagaactgccactggcccaagtcccacacgctgtggagcaacggcgtgctggagtccgagatgatcatccccaagaacctcgccggccccgtgagccagcacaactaccggccggggtaccacacccagatcgcgggcccctggcacctggggaagctggagatggacttcgacttctgcgacggcaccaccgtcatcgtgaccgaggactgcgggaaccgcggcccctccctccggacgaccaccgccagcggcaagctgatcaccgagtggtgctgccgcagctgcacgctgcccccgctccggtaccgcggggaggacggctgctggtacgggatggagatccggcccctgaaggagaaggaggagaacctggtgaactccctcgtcaccgccggccacggccaggtggacaacttcagcctgggcgtgctgggcatggccctcttcctggaggagatgctgcgcacccgggtcgggaccaagcacgcgatcctcctggtggccgtgtccttcgtcacgctgatcaccggcaacatgagcttcaaggacctcgggcgcgtggtggtcatggtgggcgccaccatggccgacgacatcgggatgggcgtgacctacctggccctgctcgcggccttcaaggtccggcccacgttcgccgccggcctgctgctccgcaagctgacctccaaggagctgatgatgaccaccatcgggatcgtgctcctgagccagtccacgatccccgagaccgtgctggagctcaccgacgccctggcgctgggcatgatggtcctcaagatcgtgcggaacatggagaagtaccagctggccgtcaccatcatggccatcctgtgcgtgccgaacgccgtgatcctccagaacgcctggaaggtcagctgcacgatcctggcggtggtgtccgtcagccccctgctcctgacctccagccagcagaagaccgactggatccccctggccctcaccatcaaggggctgaaccccacggccatcttcctgaccaccctctcccgcaccaacaagaagcgcagctggccgctgaacgaggccatcatggcggtgggcatggtgtccatcctggccagctccctcctgaagaacgacatccccatgacgggccccctggtcgccgggggcctcctgaccgtgtgctacgtgctgaccgggcggagcgccgacctcgagctggagcgcgccaccgacgtcaagtgggaggaccaggcggagatctccggcagcagccccatcctgtccatcacgatcagcgaggacgggtccatgagcatcaagaacgaggaggaggagcagaccctcaccatcctgatccggaccggcctgctcgtgatctccggcctgttcccgatcagcatccccatcacggccgccgcctggtacctgtgggaggtgaagaagcagcgcgccggggtcctctgggacgtgcccagcccgccgcccatgggcaaggcggagctggaggacggggcctaccggatcaagcagaagggcatcctggggtacagccagatcggcgccggcgtgtacaaggaggggaccttccacaccatgtggcacgtcacccgcggcgccgtgctcatgcacaaggggaagcggatcgagccctcctgggccgacgtgaagaaggacctgatcagctacggcgggggctggaagctggagggcgagtggaaggagggggaggaggtccaggtgctcgcgctggagcccggcaagaacccccgcgccgtgcagaccaagcccgggctgttcaagacgaacaccggcaccatcggggccgtctccctcgacttcagccccggcacctccggcagccccatcatcgacaagaaggggaaggtggtgggcctgtacgggaacggcgtcgtgacgcggtccggcgcctacgtgagcgccatcgcgcagaccgagaagtccatcgaggacaaccccgagatcgaggacgacatcttccgcaagcggcgcctgaccatcatggacctgcaccccggggccggcaagaccaagcggtacctccccgccatcgtccgcgaggccatcaagcgggggctgcgcacgctgatcctcgcgccgacccgggtggtggccgccgagatggaggaggccctgcgcggcctgcccatccggtaccagacccccgccatccgcgcggagcacaccgggcgggagatcgtcgacctcatgtgccacgccacgttcaccatgcgcctgctgagccccgtgcgcgtgccgaactacaacctcatcatcatggacgaggcccacttcaccgaccccgcctccatcgccgcgcggggctacatcagcacccgcgtcgagatgggcgaggccgccgggatcttcatgacggccacgccgcccggcagccgggacccgttcccccagtccaacgcccccatcatcgacgaggagcgcgagatccccgagcggagctggaactccgggcacgagtgggtgaccgacttcaagggcaagaccgtgtggttcgtcccgagcatcaaggcggggaacgacatcgccgcctgcctgcgcaagaacggcaagaaggtgatccagctgtcccggaagacgttcgacagcgagtacgtgaagacccgcaccaacgactgggacttcgtcgtgaccacggacatctccgagatgggcgccaacttcaaggcggagcgggtgatcgacccccgccggtgcatgaagcccgtcatcctcaccgacggggaggagcgcgtgatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgggagaaggtcgacgccatcgacggcgagtaccgcctgcgcggggaggcccgcaagacgttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgaccctcaacctgatcaccgagatgggccgcctgcccacgttcatgacccagaagacccgggacgccctcgacaacctggccgtgctgcacaccgccgaggccggcgggcgcgcctacaaccacgccctctccgagctgcccgagacgctggagaccctcctgctgctcaccctgctggccaccgtgaccggcgggatcttcctcttcctgatgagcgggcgggggatcgggaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacctacgtggtgatcgccatcctgacggtcgtggccgcgaccatggccaacgagatgggcttcctggagaagaccaagaaggacttcgggctcggctccatcgccacccagcagccggagagcaacatcctggacatcgacctgcggcccgcctccgcctggacgctctacgcggtggccaccaccttcgtcacccccatgctgcgccacagcatcgagaacagctccgtgaacgtgagcctgacggccatcgccaaccaggccaccgtcctcatgggcctggggaagggctggcccctgtccaagatggacatcggggtgccgctcctggcgatcggctgctacagccaggtgaaccccatcaccctgaccgccgccctcctgctgctcgtcgcccactacgcgatcatcgggcccggcctgcaggccaaggccacgcgggaggcccagaagcgcgccgcggccggcatcatgaagaaccccaccgtggacgggatcaccgtgatcgacctggacccgatcccctacgaccccaagttcgagaagcagctcggccaggtcatgctgctgatcctctgcgtgacccaggtgctgatgatgcggacgacctgggccctgtgcgaggccctcaccctggccaccgggcccatctccacgctgtgggagggcaacccggggcgcttctggaacaccaccatcgcggtcagcatggccaacatcttccggggctcctacctcgccggcgccgggctgctgttcagcatcatgaagaacaccacgaacacccgccggggcaccgggaacatcggcgagaccctcggcgagaagtggaagtcccgcctgaacgccctgggcaagagcgagttccagatctacaagaagtccggcatccaggaggtggaccgcacgctcgcgaaggaggggatcaagcggggcgagaccgaccaccacgccgtgagccgcgggtccgccaagctgcggtggttcgtcgagcgcaacatggtgacccccgagggcaaggtggtcgacctgggctgcgggcggggcgggtggagctactactgcggcgggctcaagaacgtgcgcgaggtgaagggcctgaccaagggcgggcccggccacgaggagcccatcccgatgtccacgtacgggtggaacctggtccggctccagagcggcgtggacgtgttcttcatcccgcccgagaagtgcgacaccctgctgtgcgacatcggggagtccagccccaacccgaccgtcgaggccggccgcaccctccgggtgctgaacctggtggagaactggctcaacaacaacacgcagttctgcatcaaggtcctgaacccctacatgccctccgtgatcgagaagatggaggcgctgcagcgcaagtacggcggggccctggtgcggaacccgctcagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctggggagcggcacccgcaacatcgggatcgagtccgagatccccaacctcgacatcatcggcaagcggatcgagaagatcaagcaggagcacgagacgagctggcactacgaccaggaccacccctacaagacctgggcctaccacggctcctacgagaccaagcagaccgggagcgcgtccagcatggtgaacggcgtggtccgcctgctgacgaagccgtgggacgtgctccccaccgtgacccagatggccatgaccgacacgacccccttcgggcagcagcgggtcttcaaggagaaggtggacacccgcacccaggagcccaaggagggcacgaagaagctgatgaagatcaccgccgagtggctgtggaaggagctcggcaagaagaagaccccgcgcatgtgcacccgggaggagttcacgcgcaaggtgcggtccaacgccgccctgggggcgatcttcaccgacgagaacaagtggaagtccgcccgcgaggccgtcgaggactcccggttctgggagctggtggacaaggagcgcaacctccacctggagggcaagtgcgagacctgcgtctacaacatgatggggaagcgggagaagaagctgggcgagttcgggaaggccaagggcagccgcgccatctggtacatgtggctcggcgcgcggttcctggagttcgaggccctggggttcctcaacgaggaccactggttctcccgcgagaacagcctgtccggcgtggagggggagggcctgcacaagctcgggtacatcctgcgggacgtgagcaagaaggagggcggcgccatgtacgccgacgacaccgcggggtgggacacgcgcatcaccctggaggacctcaagaacgaggagatggtcaccaaccacatggagggcgagcacaagaagctggccgaggccatcttcaagctgacctaccagaacaaggtggtgcgggtccagcgccccacgccccgggggaccgtgatggacatcatcagccgccgggaccagcgcggctccggccaggtgggcacctacggcctcaacaccttcacgaacatggaggcccagctgatccggcagatggagggggagggcgtcttcaagaacatccagcacctgaccgtgaccgaggaggtggccgtccagaactggctcgcgcgcgtggggcgggagcgcctgagccgcatggccatctccggcgacgactgcgtggtcaagcccctggacgaccggttcgccaacgccctcaccgccctgaacgacatgggcaagatccgcaaggacatccagcagtgggagccgagcaaggggtggaacgactggacgcaggtccccttctgctcccaccacttccacgagctgatcatgaaggacggccgggtgctcgtcgtgccctgccgcaaccaggacgagctgatcgggcgggcgcgcatcagccagggcgccgggtggtccctgcgggagaccgcctgcctcggcaagagctacgcccagatgtggtccctgatgtacttccaccgccgggacctgcgcctcgccgcgaacgccatctgcagcgccgtgccctcccactgggtcccgaccagccggaccacgtggtccatccacgccaagcacgagtggatgaccaccgaggacatgctgaccgtgtggaaccgcgtgtggatccgggagaacccctggatggaggacaagacccccgtcgagagctgggaggagatcccctacctgggcaagcgcgaggaccagtggtgcgggtccctcatcggcctgacgagccgggccacctgggcgaagaacatccaggccgccatcaaccaggtgcgctccctgatcgggaacgaggagtacaccgactacatgccgagcatgaagcggttccgccgggaggaggaggaggccggcgtgctctggtga

SEQ ID NO: 9579 - RNA, 9876 nt, synthetic construct
  misc_feature 1..9876: note = derived and/or modified CDS sequence (opt1) from DENV-2__EU482668__SS-prME
  source 1..9876: mol_type = other RNA
agcgcggggatgatcatcatgctgatccccaccgtgatggccttccacctcaccacccgcaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccgcggcaccgggaacatcggcgagacgctgggcgagaagtggaagtcccggctgaacgccctcggcaagagcgagttccagatctacaagaagtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacacggcggggtgggacacccgcatcaccctcgaggacctgaagaacgaggagatggtgaccaaccacatggagggcgagcacaagaagctggccgaggccatcttcaagctcacgtaccagaacaaggtcgtgcgggtgcagcgccccacgccccgggggaccgtcatggacatcatcagccgccgggaccagcgcggctccggccaggtgggcacctacggcctgaacacgttcaccaacatggaggcccagctgatccggcagatggagggggagggcgtgttcaagaacatccagcacctcaccgtcaccgaggaggtggccgtgcacaactggctggcgcgcgtcgggcgcgagcggctgagccgcatggccatctccggcgacgactgcgtggtgaagcccctcgacgaccggttcgccaacgccctgacggccctgaacgacatgggcaagatccgcaaggacatccagcagtgggagccgagcaaggggtggaacgactggacccaggtccccttctgctcccaccacttccacgagctcatcatgaaggacggccggatcctggtggtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtcccctcccactgggtgccgaccagccggacgacctggtccatccacgccaagcacgagtggatgaccaccgaggacatgctgaccgtgtggaaccgcgtctggatccgggagaacccctggatggaggacaagacgcccgtggagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacaccgactacatgccgagcatgaagcggttccgccgcgaggaggaggaggccggcgtcctgtggtga

SEQ ID NO: 9580 - RNA, 9876 nt, synthetic construct
  misc_feature 1..9876: note = derived and/or modified CDS sequence (opt1) from DENV-2__EU482669__SS-prME
  source 1..9876: mol_type = other RNA
agcgcgggcatgatcatcatgctgatccccaccgtgatggccttccacctcaccacccggaacggggagccccacatgatcgtcggcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccgcctgggtgacctacgggacctgcacgaccaccggcgagcaccggcgggagaagcgcagcgtcgccctggtgccccacgtggggatgggcctcgagacccggacggagacctggatgtccagcgagggggcctggaagcacgcccagcgcatcgagacctggatcctgcggcacccgggcttcaccatcatggcggccatcctggcctacacgatcgggaccacccacttccagcgcgtcctcatcttcatcctgctgaccgccgtggcgccctccatgacgatgcggtgcatcggcatcagcaaccgcgacttcgtggagggcgtctccgggggcagctgggtggacatcgtgctcgagcacgggtcctgcgtcaccaccatggccaagaacaagcccaccctggacttcgagctgatcaagacggaggccaagcagcccgccaccctccggaagtactgcatcgaggccaagctgaccaacaccacgaccgagagccgctgccccacccagggcgagccctccctgaaggaggagcaggacaagcggttcgtgtgcaagcacagcatggtggaccgcggctgggggaacggctgcggcctgttcggcaagggcgggatcgtgacctgcgcgatgttcacgtgcaagaagaacatggagggcaagatcgtgcagcccgagaacctggagtacaccatcgtggtcacgccccactccggggaggagcacgccgtgggcaacgacaccgggaagcacggcaaggagatcaaggtgacgccgcagagctccatcaccgaggtcgagctgaccgggtacggcaccgtgaccatggagtgcagcccccggacgggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggcgatgcacaccgccctgacgggcgccaccgagatccagatgagctccgggaacctcctgttcaccggccacctgaagtgccggctgcgcatggacaagctccagctgaagggcatgagctactccatgtgcaccgggaagttcaaggtcgtgaaggagatcgccgagacgcagcacggcaccatcgtgatccgggtccagtacgagggggacggcagcccctgcaagatccccttcgagatcatggacctggagaagcgctacgtgctcggccggctgatcaccgtgaacccgatcgtcaccgagaaggactcccccgtgaacatcgaggccgagccgcccttcggggacagctacatcatcatcggcgtggagccggggcagctgaagctcaactggttcaagaagggctccagcatcgggcagatgttcgagacgaccatgcgcggcgcgaagcgcatggccatcctgggcgacaccgcctgggacttcgggtccctgggcggggtcttcaccagcatcggcaaggccctccaccaggtgttcggggccatctacggcgcggccttctccggcgtgagctggacgatgaagatcctgatcggggtcatcatcacctggatcggcatgaactcccggagcacctccctgagcgtgtccctggtgctcgtcgggatcgtgaccctgtacctgggcgtgatggtccaggccgacagcgggtgcgtggtgtcctggaagaacaaggagctcaagtgcggcagcggcatcttcatcacggacaacgtccacacctggaccgagcagtacaagttccagcccgagagcccctccaagctggccagcgcgatccagaaggcccaggaggaggggatctgcggcatccgctccgtgacccggctggagaacctcatgtggaagcagatcacgcccgagctgaaccacatcctggccgagaacgaggtgaagctcaccatcatgaccggggacatcaagggcatcatgcaggccgggaagcgcagcctgcggccgcagcccaccgagctgaagtactcctggaagacgtggggcaaggccaagatgctcagcaccgagtcctacaaccagaccttcctgatcgacggccccgagaccgcggagtgcccgaacacgaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacctggaagatcgagaaggccagcttcatcgaggtcaagaactgccactggcccaagtcccacacgctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgaccgaggactgcgggaaccggggcccctccctccgcacgaccaccgccagcggcaagctgatcaccgagtggtgctgccggagctgcacgctgcccccgctccgctaccgcggggaggacggctgctggtacgggatggagatccgccccctgaaggagaaggaggagaacctggtgaactccctcgtcaccgccggccacgggcaggtcgacaacttcagcctgggcgtgctgggcatggccctcttcctggaggagatgctgcggacccgcgtcgggaccaagcacgcgatcctcctggtggccgtgtccttcgtcacgctgatcaccggcaacatgagcttcaaggacctcgggcgggtggtggtcatggtgggcgccaccatggccgacgacatcgggatgggcgtgacctacctggccctgctcgcggccttcaaggtccgccccacgttcgccgccggcctgctgctccggaagctgacctccaaggagctgatgatgaccaccatcgggatcgtgctcctgagccagtccacgatccccgagaccgtgctggagctcaccgacgccctggcgctgggcatgatggtcctcaagatcgtgcgcaacatggagaagtaccagctggccgtcaccatcatggccatcctgtgcgtgccgaacgccgtgatcctccagaacgcctggaaggtcagctgcacgatcctggcggtggtgtccgtcagccccctgctcctgacctccagccagcagaagaccgactggatccccctggccctcaccatcaaggggctgaaccccacggccatcttcctgaccaccctctcccgcaccaacaagaagcggagctggccgctgaacgaggccatcatggcggtgggcatggtgtccatcctggccagctccctcctgaagaacgacatccccatgacgggccccctggtcgccgggggcctcctgaccgtgtgctacgtgctgaccgggcgcagcgccgacctcgagctggagcgggccaccgacgtcaagtgggaggaccaggcggagatctccggcagcagccccatcctgtccatcacgatcagcgaggacgggtccatgagcatcaagaacgaggaggaggagcagaccctcaccatcctgatccgcaccggcctgctcgtgatctccggcctgttcccgatcagcatccccatcacggccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagaccaagcccgggctgttcaagacgaacaccggcaccatcggggccgtctccctcgacttcagccccggcacctccggcagccccatcatcgacaagaaggggaaggtggtgggcctgtacgggaacggcgtcgtgacgcgctccggcgcctacgtgagcgccatcgcgcagaccgagaagtccatcgaggacaaccccgagatcgaggacgacatcttccggaagcgccggctgaccatcatggacctgcaccccggggccggcaagaccaagcgctacctccccgccatcgtccgggaggccatcaagcgcgggctgcggacgctgatcctcgcgccgacccgcgtggtggccgccgagatggaggaggccctgcggggcctgcccatccgctaccagacccccgccatcaaggcggagcacaccgggcgggagatcgtcgacctcatgtgccacgccacgttcaccatgcgcctgctgagccccgtgcgcgtgccgaactacaacctcatcatcatggacgaggcccacttcaccgaccccgcctccatcgccgcgcggggctacatcagcacccgcgtcgagatgggcgaggccgccgggatcttcatgacggccacgccgcccggcagccgggacccgttcccccagtccaacgcccccatcatcgacgaggagcgcgagatccccgagcggagctggaactccgggcacgagtgggtgaccgactacaagggcaagaccgtgtggttcgtcccgagcatcaaggcggggaacgacatcgccgcctgcctgcgcaagaacggcaagaaggtgatccagctgtcccggaagacgttcgacagcgagtacgtgaagacccgcaccaacgactgggacttcgtcgtgaccacggacatctccgagatgggcgccaacttcaaggcggagcgggtgatcgacccccgccggtgcatgaagcccgtcatcctcaccgacggggaggagcgcgtgatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgggagaaggtcgacgccatcgacggcgagtaccgcctgcgcggggaggcccgcaagacgttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgaccctcaacctgatcaccgagatgggccgcctgcccacgttcatgacccagaagacccgggacgccctcgacaacctggccgtgctgcacaccgccgaggccggcgggcgcgcctacaaccacgccctctccgagctgcccgagacgctggagaccctcctgctgctcaccctgctggccaccgtgaccggcgggatcttcctcttcctgatgagcgggcgggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacctacgtggtgatcgccatcctgacggtcgtggccgcgaccatggccaacgagatgggcttcctggagaagaccaagaaggacctcgggctgggctccatcgccacccagcagccggagagcaacatcctggacatcgacctccggcccgcctccgcctggacgctgtacgcggtggccaccaccttcgtcacccccatgctgcgccacagcatcgagaacagctccgtgaacgtgagcctcacggccatcgccaaccaggccaccgtcctgatgggcctggggaagggctggcccctctccaagatggacatcggggtgccgctgctggcgatcggctgctacagccaggtgaaccccatcaccctcaccgccgccctgctgctcctggtcgcccactacgcgatcatcgggcccggcctgcaggccaaggccacgcgggaggcccagaagcgcgccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggacgacctgggccctctgcgaggccctgaccctggccaccgggcccatctccacgctctgggagggcaacccggggcgcttctggaacaccaccatcgcggtcagcatggccaacatcttccggggctcctacctggccggcgccgggctcctcttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtggaccgcacgctggcgaaggaggggatcaagcggggcgagaccgaccaccacgccgtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgaccaagggcgggcccggccacgaggagcccatcccgatgtccacgtacgggtggaacctcgtccggctgcagagcggcgtggacgtgttcttcatcccgcccgagaagtgcgacaccctgctctgcgacatcggggagtccagccccaacccgaccgtcgaggccggccgcaccctgcgggtgctgaacctcgtggagaactggctgaacaacaacacgcagttctgcatcaaggtcctgaacccctacatgccctccgtgatcgagaagatggaggcgctgcagcgcaagtacggcggggccctcgtgcggaacccgctgagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctcgggagcggcacccgcaacatcgggatcgagtccgagatccccaacctggacatcatcggcaagcggatcgagaagatcaagcaggagcacgagacgagctggcactacgaccaggaccacccctacaagacctgggcctaccacggctcctacgagaccaagcagaccgggagcgcgtccagcatggtgaacggcgtggtccgcctgctcacgaagccgtgggacgtgctgcccaccgtgacccagatggccatgaccgacacgacccccttcgggcagcagcgggtcttcaaggagaaggtggacacccgcacccaggagcccaaggagggcacgaagaagctgatgaagatcaccgccgagtggctctggaaggagctgggcaagaagaagaccccgcgcatgtgcacccgggaggagttcacgcgcaaggtgcggtccaacgccgccctgggggcgatcttcaccgacgagaacaagtggaagtccgcccgcgaggccgtcgaggactcccggttctgggagctcgtggacaaggagcgcaacctgcacctggagggcaagtgcgagacctgcgtctacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtggagggggagggcctccacaagctggggtacatcctgcgggacgtgagcaagaaggagggcggcgccatgtacgccgacgacaccgcggggtgggacacgcgcatcaccctcgaggacctgaagaacgaggagatggtcaccaaccacatggagggcgagcacaagaagctggccgaggccatcttcaagctcacctaccagaacaaggtggtgcgggtccagcgccccacgccccgggggaccgtgatggacatcatcagccgccgggaccagcgcggctccggccaggtggggacctacggcctgaacaccttcacgaacatggaggcccagctgatccggcagatggagggggagggcgtcttcaagaccatccagcacctcaccgtgaccgaggaggtggccgtccagaactggctggcgcgcgtggggcgggagcgcctgagccgcatggccatctccggcgacgactgcgtggtcaagcccctcgacgaccggttcgccaacgccctgacggccctgaacgacatgggcaagatccgcaaggacatccagcagtgggagccgagcaaggggtggaacgactggacccaggtgcccttctgctcccaccacttccacgagctcatcatgaaggacggccgggtgctggtcgtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacaccgactacatgccgagcatgaagcggttccgccgggaggaggaggaggccggcgtgctgtggtga

SEQ ID NO: 9581 - RNA, 9876 nt, synthetic construct
  misc_feature 1..9876: note = derived and/or modified CDS sequence (opt1) from DENV-2__EU482670__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtgatgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccaggtggcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggtggccgtgcagaactggctggcgcgggtcgggcgcgagcgcctgagccggatggccatctccggcgacgactgcgtggtgaagcccctcgacgaccgcttcgccaacgccctgacggccctgaacgacatgggcaagatccggaaggacatccagcagtgggagccgagcaaggggtggaacgactggacccaggtccccttctgctcccaccacttccacgagctcatcatgaaggacggccgcatcctggtggtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacaccgactacatgccgagcatgaagcgcttccggcgcgaggaggaggaggccggcgtcctgtggtga

SEQ ID NO: 9582 - RNA, 9876 nt, synthetic construct
  misc_feature 1..9876: note = derived and/or modified CDS sequence (opt1) from DENV-2__EU482671__SS-prME
  source 1..9876: mol_type = other RNA
agcgcggggatgatcatcatgctgatccccaccgtgatggccttccacctcaccacccgcaacggggagccccacatgatcgtggggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcatctgcaagcacagcatggtggaccgcggctgggggaacggctgcggcctgttcggcaagggcgggatcgtgacgtgcgccatgttcacgtgcaagaagaacatggagggcaagatcgtccagcccgagaacctggagtacaccatcgtggtgacgccccactccggggaggagcacgcggtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcaggagtccaactggatccagaaggagaccctggtgaccttcaagaacccccacgccaagaagcaggacgtcgtggtcctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgcgggagatcgccgagacccagcacggcaccatcgtcatccgcgtgcagtacgagggggacggcagcccctgcaagatccccttcgagatcatggacctggagaagcggtacgtgctcggccgcctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcggatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccgcagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccggtccgtgacgcgcctggagaacctcatgtggaagcagatcacccccgagctgaaccacatcctggccgagaacgaggtcaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtgttcaccaccaacatctggctcaagctgaaggagaagcaggacgccttctgcgactccaagctgatgagcgccgccatcaaggacaaccgcgcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccggccggggtaccacacccagatcgcgggcccctggcacctggggaagctggagatggacttcgacttctgcgacggcaccaccgtgatcgtgacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtcaactccctcgtgaccgccggccacggccaggtggacaacttcagcctgggcgtcctgggcatggccctcttcctggaggagatgctgcgcacccgggtggggacgaagcacgcgatcctcctggtggccgtctccttcgtgaccctgatcaccggcaacatgagcttcaaggacctcgggcgcgtggtcgtgatggtgggcgccaccatggccgacgacatcgggatgggcgtcacgtacctggccctgctcgcggccttcaaggtgcggcccaccttcgccgccggcctgctgctccgcaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtgggcatggtctccatcctggccagctccctcctgaagaacgacatccccatgaccggccccctggtggccgggggcctcctgaccgtgtgctacgtcctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtcaagaagcagcgcgccggggtgctctgggacgtgcccagcccgccgcccatgggcaaggcggagctggaggacggggcctaccggatcaagcagaagggcatcctggggtacagccagatcggcgccggcgtctacaaggaggggaccttccacaccatgtggcacgtgacccgcggcgccgtgctcatgcacaaggggaagcggatcgagccctcctgggccgacgtcaagaaggacctgatcagctacggcgggggctggaagctggagggcgagtggaaggagggggaggaggtccaggtgctcgcgctggagcccggcaagaacccccgcgccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccggtccggcgcctacgtcagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtggtcgccgccgagatggaggaggccctgcgcggcctgcccatccggtaccagacccccgccatccgcgcggagcacacggggcgcgagatcgtggacctcatgtgccacgccaccttcaccatgcggctgctgagccccgtgcgcgtcccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtctggttcgtgccgagcatcaaggcggggaacgacatcgccgcctgcctgcgcaagaacggcaagaaggtgatccagctgtcccggaagaccttcgacagcgagtacgtcaagacccgcaccaacgactgggacttcgtggtgacgaccgacatctccgagatgggcgccaacttcaaggcggagcgggtcatcgacccccgccggtgcatgaagcccgtgatcctcaccgacggggaggagcgcgtgatcctggccggccccatgccggtcacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtggacctcatgcgccggggcgacctgcccgtctggctggcctacaaggtggccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtgctgcacacggccgaggccggcgggcgcgcctacaaccacgccctctccgagctgcccgagaccctggagaccctcctgctgctcaccctgctggccacggtcaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtggtcatcgccatcctgaccgtggtggccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtcgccaccaccttcgtgacgcccatgctgcgccacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcaccctcacggccgccctgctgctcctggtggcccactacgcgatcatcgggcccggcctgcaggccaaggccacccgggaggcccagaagcgcgccgcggccggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccgcggcaccgggaacatgggcgagacgctgggcgagaagtggaagtcccggctgaacgccctcggcaagagcgagttccagatctacaagcgctccggcatccaggaggtggaccggaccctggcgaaggaggggatcaagcgcggcgagaccgaccaccacgccgtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgacgaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgaccgtggaggccggccggacgctgcgcgtgctgaacctcgtcgagaactggctgaacaacaacacccagttctgcatcaaggtgctgaacccctacatgccctccgtgatcgagaagatggaggcgctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcgcctgctcaccaagccgtgggacgtgctgcccaccgtcacccagatggccatgacggacaccacccccttcgggcagcagcgggtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgcgggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggtcgccgtgcagaactggctggcgcgcgtggggcgggagcgcctgagccggatggccatctccggcgacgactgcgtcgtgaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacaccgactacatgccgagcatgaagcgcttccgccgggaggaggaggaggccggcgtcctgtggtga

SEQ ID NO: 9583 - RNA, 9876 nt, synthetic construct
  misc_feature 1..9876: note = derived and/or modified CDS sequence (opt1) from DENV-2__EU482674__SS-prME
  source 1..9876: mol_type = other RNA
agcgccggcatgatcatcatgctgatccccaccgtgatggccttccacctcaccacccggaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaactccaccagcacctgggtgacctacgggacctgcaccaccaccggcgagcaccggcgggagaagcgctccgtcgccctggtgccccacgtgggcatggggctcgagacccggaccgagacctggatgagctccgagggcgcctggaagcacgcccagcggatcgagacctggatcctgcggcacccggggttcacgatcatggccgcgatcctggcctacaccatcggcaccacccacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggcgaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagcacgcggtggggaacgacacgggcaagcacgggaaggagatcaaggtgaccccgcagtccagcatcaccgaggccgagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacaagcaggagagcaactggatccagaaggagaccctggtcaccttcaagaacccccacgccaagaagcaggacgtggtcgtgctcgggagccaggagggcgcgatgcacacggccctgaccggggccaccgagatccagatgtccagcggcaacctgctgttcaccgggcacctgaagtgccggctgcgcatggacaagctccagctgaagggcatgtcctacagcatgtgcacgggcaagttcaaggtggtcaaggagatcgccgagacccagcacgggaccatcgtgatccgggtgcagtacgagggcgacgggtccccctgcaagatccccttcgagatcatggacctggagaagcgctacgtcctcggccggctgatcaccgtgaacccgatcgtgacggagaaggacagccccgtcaacatcgaggccgagccgcccttcggcgactcctacatcatcatcggggtggagccgggccagctgaagctcaactggttcaagaaggggagctccatcggccagatgttcgagaccaccatgcgcggggcgaagcgcatggccatcctgggcgacaccgcctgggacttcggcagcctcggcggggtgttcacgtccatcgggaaggccctccaccaggtcttcggggccatctacggggcggccttcagcggcgtgtcctggaccatgaagatcctgatcggcgtgatcatcacctggatcgggatgaacagccggtccaccagcctgtccgtcagcctggtgctcgtgggcatcgtcacgctgtacctgggggtgatggtgcaggccgactccggctgcgtcgtgagctggaagaacaaggagctcaagtgcgggagcggcatcttcatcaccgacaacgtgcacacctggaccgagcagtacaagttccagcccgagtcccccagcaagctggcctccgcgatccagaaggcccaggaggagggcatctgcgggatccgcagcgtcacgcggctggagaacctcatgtggaagcagatcacccccgagctgaaccacatcctggccgagaacgaggtgaagctcaccatcatgaccggcgacatccgcgggatcatgcaggccggcaagcggtccctgcgcccgcagcccacggagctgaagtacagctggaagacctgggggaaggccaagatgctctccaccgagagctacaaccagaccttcctgatcgacggccccgagacggcggagtgcccgaacaccaaccgggcctggaactccctggaggtggaggactacggcttcggggtcttcaccaccaacatctggctcaagctgaaggagaagcaggacgccttctgcgacagcaagctgatgtccgccgccatcaaggacaaccgcgcggtgcacgccgacatgggctactggatcgagagcgccctcaacgacacgtggaagatcgagaaggcctccttcatcgaggtgaagaactgccactggcccaagagccacaccctgtggtccaacggggtcctggagagcgagatgatcatccccaagaacctcgccggccccgtgtcccagcacaactaccggccgggctaccacacccagatcgcggggccctggcacctgggcaagctggagatggacttcgacttctgcgacgggaccaccgtgatcgtcacggaggactgcggcaaccgcgggcccagcctccggaccaccaccgccagcggcaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccaggtcgacaacttctccctgggggtgctgggcatggccctcttcctggaggagatgctgcgcacccgggtgggcacgaagcacgcgatcctcctggtcgccgtgagcttcgtgaccctgatcaccgggaacatgtccttcaaggacctcggccgcgtcgtggtgatggtcggggccaccatggccgacgacatcggcatgggggtgacgtacctggccctgctcgcggccttcaaggtgcggcccaccttcgccgccggcctgctgctccgcaagctgaccagcaaggagctgatgatgaccacgatcggcatcgtcctcctgtcccagagcaccatccccgagaccgtgctggagctcaccgacgccctggcgctggggatgatggtgctcaagatcgtccgcaacatggagaagtaccagctggccgtgacgatcatggccatcctgtgcgtcccgaacgccgtgatcctccagaacgcctggaaggtgtcctgcaccatcctggcggtcgtgagcgtgagccccctgctcctgaccagctcccagcagaagaccgactggatccccctggccctcacgatcaagggcctgaaccccaccgccatcttcctgaccaccctcagccggacgaacaagaagcgctcctggccgctgaacgaggccatcatggcggtcgggatggtgagcatcctggcctccagcctcctgaagaacgacatccccatgaccggccccctggtggccggcgggctcctgaccgtctgctacgtgctgaccggccggtccgccgacctcgagctggagcgcgccacggacgtgaagtgggaggaccaggcggagatcagcgggagctcccccatcctgagcatcaccatctccgaggacggcagcatgtccatcaagaacgaggaggaggagcagaccctcaccatcctgatccggacggggctgctcgtcatcagcggcctgttcccgatctccatccccatcaccgccgccgcctggtacctgtgggaggtgaagaagcagcgcgccggcgtgctctgggacgtcccctccccgccgcccatggggaaggcggagctggaggacggcgcctaccggatcaagcagaaggggatcctgggccactcccagatcggggccggcgtgtacaaggagggcaccttccacaccatgtggcacgtgacccgcggggccgtcctcatgcacaagggcaagcggatcgagcccagctgggccgacgtgaagaaggacctgatctcctacgggggcgggtggaagctggagggcgagtggaaggagggcgaggaggtgcaggtcctcgcgctggagcccgggaagaacccccgcgccgtgcagacgaagcccggcctgttcaagaccaacaccgggaccatcggcgccgtgagcctcgacttctcccccgggacgagcggctcccccatcatcgacaagaagggcaaggtcgtggggctgtacggcaacggggtggtcacccggagcggcgcctacgtgtccgccatcgcgcagaccgagaagaacatcgaggacaaccccgagatcgaggacgacatcttccgcaagcggcgcctgaccatcatggacctgcaccccggcgccgggaagacgaagcggtacctccccgccatcgtgcgcgaggccatcaagcggggcctgcgcaccctgatcctcgcgccgacccgggtcgtggccgccgagatggaggaggccctgcgcgggctgcccatccggtaccagacccccgccatccgcgcggagcacacgggccgcgagatcgtggacctcatgtgccacgccaccttcaccatgcggctgctgagccccgtccgcgtgccgaactacaacctcatcatcatggacgaggcccacttcaccgaccccgcctccatcgccgcgcgggggtacatcagcacgcgcgtggagatgggcgaggccgccggcatcttcatgaccgccacgccgcccgggagccgggacccgttcccccagtccaacgcccccatcatcgacgaggagcgcgagatccccgagcggagctggaactccggccacgagtgggtcaccgacttcaaggggaagacggtgtggttcgtgccgagcatcaaggcgggcaacgacatcgccgcctgcctgcgcaagaacgggaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggcgaggagcgcgtcatcctggccgggcccatgccggtgacccacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacgcccgaggggatcatcccgagcatgttcgagcccgagcgggagaaggtggacgccatcgacggcgagtaccgcctgcgcggcgaggcccggaagaccttcgtcgacctcatgcgccgcggggacctgcccgtgtggctggcctacaaggtggccgcggagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcggggcggaagtccctgaccctcaacctgatcacggagatgggccgcctgcccaccttcatgacccagaagacccgggacgccctcgacaacctggccgtcctgcacacggccgaggcgggcgggcgcgcctacaaccacgccctctccgagctgcccgagaccctggagaccctcctgctgctcaccctgctggccacggtgaccggcgggatcttcctcttcctgatgagcggccggggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatggggttcctggagaagaccaagaaggacctcggcctggggtccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctgggcaaggggtggcccctctccaagatggacatcggcgtcccgctgctggcgatcgggtgctacagccaggtgaaccccatcaccctcacggccgccctgctgctcctggtggcccactacgcgatcatcggccccgggctgcaggccaaggccacccgggaggcccagaagcgcgccgcggccggcatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacgggccccatctccaccctctgggaggggaacccgggccgcttctggaacaccaccatcgcggtgagcatggccaacatcttccgggggtcctacctggccggcgccggcctcctgttcagcatcatgaagaacacgaccaacacccgccgcgggaccggcaacatcggggagacgctgggcgagaagtggaagtcccggctgaacgccctcggcaagagcgagttccagatctacaagaagtccgggatccaggaggtcgaccgcaccctggcgaaggagggcatcaagcgcggggagaccgaccaccacgccgtgagccgcggctccgccaagctgcggtggttcgtggagcgcaacatggtcacccccgaggggaaggtggtggacctcggctgcggccgcggcgggtggagctactactgcggcgggctgaagaacgtccgcgaggtgaaggggctgacgaagggcgggcccgggcacgaggagcccatcccgatgtccacctacggctggaacctcgtgcggctgcagagcggggtcgacgtgttcttcatcccgcccgagaagtgcgacaccctgctctgcgacatcggcgagtccagccccaacccgaccgtggaggccgggcgcacgctgcgggtcctgaacctcgtggagaactggctgaacaacaacacccagttctgcatcaaggtgctgaacccctacatgccctccgtcatcgagaagatggaggcgctgcagcgcaagtacggcggcgccctcgtgcggaacccgctgagccgcaacagcacccacgagatgtactgggtgtccaacgccagcgggaacatcgtctccagcgtgaacatgatctcccggatgctgatcaaccgcttcaccatgcggcacaagaaggccacctacgagcccgacgtggacctcggcagcgggacgcgcaacatcggcatcgagtccgagaagcccaacctggacatcatcgggaagcggatcgagaagatcaagcaggagcacgagaccagctggcactacgaccaggaccacccctacaagacctgggcctaccacggctcctacgagaccaagcagacgggcagcgcgtccagcatggtcaacggggtggtgcgcctgctcaccaagccgtgggacgtcctgcccaccgtgacccagatggccatgacggacaccacccccttcggccagcagcgcgtgttcaaggagaaggtcgacacccggacgcaggagcccaaggaggggaccaagaagctgatgaagatcaccgccgagtggctctggaaggagctgggcaagaagaagaccccgcgcatgtgcacgcgggaggagttcacccgcaaggtgcggtccaacgccgccctgggcgcgatcttcaccgacgagaacaagtggaagtccgcccgcgaggccgtggaggactcccggttctgggagctcgtcgacaaggagcgcaacctgcacctggaggggaagtgcgagacctgcgtgtacaacatgatgggcaagcgggagaagaagctcggggagttcggcaaggccaaggggagccgcgccatctggtacatgtggctgggcgcgcggttcctggagttcgaggccctcggcttcctgaacgaggaccactggttctcccgcgagaacagcctgtccggggtcgagggcgaggggctccacaagctgggctacatcctgcgggacgtgagcaagaaggagggcggggccatgtacgccgacgacacggcgggctgggacacccgcatcaccctcgaggacctgaagaacgaggagatggtgaccaaccacatggagggggagcacaagaagctggccgaggccatcttcaagctcacgtaccagaacaaggtcgtgcgggtgcagcgccccacgccccggggcaccgtcatggacatcatcagccgccgggaccagcgcgggtccggccaggtggggacctacggcctgaacacgttcaccaacatggaggcccagctgatccggcagatggagggcgagggggtgttcaagaacatccagcacctcaccgtcaccgaggaggtggccgtgcacaactggctggcgcgcgtcggccgcgagcggctgagccgcatggccatctccggggacgactgcgtggtgaagcccctcgacgaccggttcgccaacgccctgacggccctgaacgacatgggcaagatccgcaaggacatccagcagtgggagccgagcaagggctggaacgactggacccaggtccccttctgctcccaccacttccacgagctcatcatgaaggacgggcgggtgctggtggtcccctgccgcaaccaggacgagctgatcggccgggcgcgcatcagccagggggccggctggtccctccgggagaccgcctgcctgggcaagagctacgcccagatgtggtccctgatgtacttccaccgccgggacctccgcctggccgcgaacgccatctgcagcgccgtgccctcccactgggtgccgaccagccggacgacctggtccatccacgccaagcacgagtggatgaccaccgaggacatgctgaccgtctggaaccgcgtgtggatccgggagaacccctggatggaggacaagacgcccgtggagagctgggaggagatcccctacctcggcaagcgcgaggaccagtggtgcggctccctgatcgggctgaccagccgggccacctgggcgaagaacatccaggccgccatcaaccaggtccgctccctcatcggcaacgaggagtacaccgactacatgccgagcatgaagcggttccgccgcgaggaggaggaggccggggtgctgtggtga

SEQ ID NO: 9584 - RNA, 9876 nt, synthetic construct
  misc_feature 1..9876: note = derived and/or modified CDS sequence (opt1) from DENV-2__EU482676__SS-prME
  source 1..9876: mol_type = other RNA
agcgccagcatgatcatcatgctgatccccaccgtgatggccttccacctcaccacccgcaacggcgagccccacatgatcgtcgggatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcacccggggttcacgatcatggccgcgatcctggcctacaccatcggcaccacccacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggcgaagaacaagcccacgctggacttcgagctgatcaagaccgaggccaagcagcccgccaccctccggaagtactgcatcaaggccaagctgaccaacacgaccaccgagtcccgctgccccacccagggggagcccagcctgaaggaggagcaggacaagcggttcgtgtgcaagcactccatggtggaccgcggctggggcaacgggtgcggcctcttcgggaagggcgggatcgtcacgtgcgccatgttcacgtgcaagaagaacatggagggccggatcgtgcagcccgagaacctggagtacaccatcgtggtcacgccccacagcggcgaggagcacgcggtggggaacgacacgggcaagcacgggaaggagatcaaggtgaccccgcagtccagcatcaccgaggccgagctgaccggctacgggaccgtcacgatggagtgcagcccccggaccggcctcgacttcaacgagatggtgctgctgcagatggagaacaaggcctggctcgtgcaccggcagtggttcctggacctgcccctcccctggctgccgggcgccgacaagcaggagagcaactggatccagaaggagaccctggtcaccttcaagaacccccacgccaagaagcaggacgtggtcgtgctcgggagccaggagggcgcgatgcacacggccctgaccggggccaccgagatccagatgtccagcggcaacctgctgttcaccgggcacctgaagtgccgcctgcggatggacaagctccagctgaagggcatgtcctacagcatgtgcacgggcaagttcaaggtggtcaaggagatcgccgagacccagcacgggaccatcgtgatccgcgtgcagtacgagggcgacgggtccccctgcaagatccccttcgagatcatggacctggagaagcggtacgtcctcggccgcctgatcaccgtgaacccgatcgtgacggagaaggacagccccgtcaacatcgaggccgagccgcccttcggcgactcctacatcatcatcggggtggagccgggccagctgaagctcaactggttcaagaaggggagctccatcggccagatgttcgagaccaccatgcgcggggcgaagcggatggccatcctgggcgacaccgcctgggacttcggcagcctcggcggggtgttcacgtccatcgggaaggccctccaccaggtcttcggggccatctacggggcggccttcagcggcgtgtcctggaccatgaagatcctgatcggcgtgatcatcacctggatcgggatgaacagccgctccaccagcctgtccgtcagcctggtgctcgtgggcatcgtcacgctgtacctgggggtgatggtgcaggccgactccggctgcgtcgtgagctggaagaacaaggagctcaagtgcgggagcggcatcttcatcaccgacaacgtgcacacctggaccgagcagtacaagttccagcccgagtcccccagcaagctggcctccgcgatccagaaggcccaggaggagggcatctgcgggatccggagcgtcacgcgcctggagaacctcatgtggaagcagatcacccccgagctgaaccacatcctggccgagaacgaggtgaagctcaccatcatgaccggcgacatcaaggggatcatgcaggccggcaagcggtccctgcgcccgcagcccacggagctgaagtacagctggaagacctgggggaaggccaagatgctctccaccgagagctacaaccagaccttcctgatcgacggccccgagacggcggagtgcccgaacaccaaccgggcctggaactccctggaggtggaggactacggcttcggggtcttcaccaccaacatctggctcaagctgaaggagaagcaggacgtgttctgcgacagcaagctgatgtccgccgccatcaaggacaaccgcgccgtgcacgcggacatgggctactggatcgagagcgccctcaacgacacgtggaagatcgagcgggcctccttcatcgaggtcaagaactgccactggcccaagagccacaccctgtggtccaacggggtgctggagagcgagatgatcatccccaagaacctcgccggccccgtgtcccagcacaactaccgcccgggctaccacacccagatcgccgggccctggcacctgggcaagctggagatggacttcgacttctgcgacgggaccaccgtcatcgtgacggaggactgcggcaaccgggggcccagcctccgcaccaccaccgcgagcggcaagctgatcacggagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccaggtggacaacttctccctgggggtgctgggcatggccctcttcctggaggagatgctgcggacccgcgtcggcacgaagcacgccatcctcctggtggcggtgagcttcgtcaccctgatcaccgggaacatgtccttcaaggacctcggccgggtggtggtcatggtgggggccaccatggccgacgacatcggcatgggggtgacgtacctggccctgctcgccgcgttcaaggtccgccccaccttcgccgccggcctgctgctccgcaagctgaccagcaaggagctgatgatgaccacgatcggcatcgtgctcctgtcccagagcaccatccccgagaccgtgctggagctcaccgacgccctggccctggggatgatggtcctcaagatcgtgcggaacatggagaagtaccagctggcggtcacgatcatggccatcctgtgcgtgccgaacgccgtgatcctccagaacgcctggaaggtctcctgcaccatcctggccgtggtgagcgtcagccccctgctcctgaccagctcccagcagaagaccgactggatccccctggcgctcacgatcaagggcctgaaccccaccgccatcttcctgaccaccctcagccgcacgaacaagaagcggtcctggccgctgaacgaggccatcatggccgtggggatggtgagcatcctggcgtccagcctcctgaagaacgacatccccatgaccggccccctggtcgccggcgggctcctgaccgtgtgctacgtgctgaccggccgctccgccgacctcgagctggagcgggccacggacgtcaagtgggaggaccaggccgagatcagcgggagctcccccatcctgagcatcaccatctccgaggacggcagcatgtccatcaagaacgaggaggaggagcagaccctcaccatcctgatccgcacggggctgctcgtgatcagcggcctgttcccgatctccatccccatcaccgcggccgcctggtacctgtgggaggtgaagaagcagcgggccggcgtcctctgggacgtgccctccccgccgcccatggggaaggccgagctggaggacggcgcgtaccgcatcaagcagaaggggatcctgggctactcccagatcggggccggcgtgtacaaggagggcaccttccacaccatgtggcacgtcacccgcggggccgtgctcatgcacaagggcaagcgcatcgagcccagctgggccgacgtgaagaaggacctgatctcctacgggggcgggtggaagctggagggcgagtggaaggagggcgaggaggtccaggtgctcgccctggagcccgggaagaacccccgggcggtgcagacgaagcccggcctgttcaagaccaacaccgggaccatcggcgccgtcagcctcgacttctcccccgggacgagcggctcccccatcatcgacaagaagggcaaggtggtggggctgtacggcaacggggtcgtgacccgcagcggcgcctacgtgtccgccatcgcccagaccgagaagtccatcgaggacaaccccgagatcgaggacgacatcttccggaagcgccggctgaccatcatggacctgcaccccggcgcggggaagacgaagcgctacctccccgccatcgtccgggaggccatcaagcgcggcctgcggaccctgatcctcgccccgacccgcgtggtggcggccgagatggaggaggccctgcgggggctgcccatccgctaccagacccccgccatccgcgccgagcacacgggccgggagatcgtcgacctcatgtgccacgcgaccttcaccatgcgcctgctgtcccccgtgcgggtgccgaactacaacctcatcatcatggacgaggcccacttcaccgaccccgccagcatcgccgcccgcgggtacatcagcacgcgggtcgagatgggcgaggcggccggcatcttcatgaccgccacgccgcccgggtcccgcgacccgttcccccagagcaacgcccccatcatcgacgaggagcgggagatccccgagcgctcctggaacagcggccacgagtgggtgaccgacttcaaggggaagacggtgtggttcgtcccgtccatcaaggccggcaacgacatcgcggcctgcctgcggaagaacgggaagaaggtgatccagctgagccgcaagaccttcgactccgagtacgtgaagacccggaccaacgactgggacttcgtcgtgacgaccgacatcagcgagatgggcgccaacttcaaggccgagcgcgtgatcgacccccggcgctgcatgaagcccgtcatcctcaccgacggcgaggagcgggtgatcctggcggggcccatgccggtgacccactccagcgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgaggggatcatcccgtccatgttcgagcccgagcgcgagaaggtcgacgcgatcgacggcgagtaccgcctgcggggcgaggcccgcaagaccttcgtggacctcatgcggcgcggggacctgcccgtgtggctggcctacaaggtcgccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctacagcgaccccctcgccctgaaggagttcaaggagttcgccgccgggcgcaagtccctgaccctcaacctgatcacggagatgggccggctgcccaccttcatgacccagaagacccgcgacgcgctcgacaacctggccgtgctgcacacggccgaggccggcgggcgggcgtacaaccacgccctcagcgagctgcccgagaccctggagaccctcctgctgctcaccctgctggccacggtgaccggcgggatcttcctcttcctgatgtccggccgcggcatcgggaagatgaccctgggcatgtgctgcatcatcaccgccagcatcctcctgtggtacgcccagatccagccgcactggatcgcggcctccatcatcctggagttcttcctcatcgtcctgctgatccccgagcccgagaagcagcggacgccccaggacaaccagctcacgtacgtggtgatcgccatcctgaccgtcgtggccgccaccatggcgaacgagatggggttcctggagaagaccaagaaggacttcggcctcgggagcatcgccacgcagcagccggagtccaacatcctggacatcgacctgcgccccgccagcgcctggaccctctacgccgtggcgaccaccttcgtcacgcccatgctgcggcacagcatcgagaactccagcgtgaacgtgtccctgaccgccatcgccaaccaggccaccgtcctcatgggcctgggcaaggggtggcccctgagcaagatggacatcggcgtgccgctcctggccatcgggtgctactcccaggtgaaccccatcaccctgacggcggccctcctgctgctcgtcgcccactacgccatcatcggccccgggctgcaggcgaaggccacccgcgaggcccagaagcgggccgccgcgggcatcatgaagaaccccaccgtggacggcatcaccgtgatcgacctggacccgatcccctacgaccccaagttcgagaagcagctcgggcaggtcatgctgctgatcctctgcgtgacccaggtgctgatgatgcgcaccacctgggccctgtgcgaggccctcaccctggccacgggccccatcagcaccctgtgggaggggaacccgggccggttctggaacaccaccatcgccgtctccatggcgaacatcttccgcgggagctacctcgccggcgccggcctgctgttctccatcatgaagaacacgaccaacacccgccgggggaccggcaacatcggggagacgctcggcgagaagtggaagtcccgcctgaacgccctgggcaagtccgagttccagatctacaagaagtccgggatccaggaggtggaccggaccctcgccaaggagggcatcaagcgcggggagaccgaccaccacgcggtgtcccggggcagcgccaagctgcgctggttcgtcgagcggaacatggtgacccccgaggggaaggtggtcgacctgggctgcggccgcgggggctggtcctactactgcgggggcctccggaacgtgcgcgaggtgaaggggctgacgaagggcggccccgggcacgaggagcccatcccgatgagcacctacggctggaacctggtccggctccagtccggggtggacgtgttcttcatcccgcccgagaagtgcgacaccctgctgtgcgacatcggcgagagctcccccaacccgaccgtcgaggccgggcgcacgctccgggtgctgaacctggtggagaactggctcaacaacaacacccagttctgcatcaaggtcctgaacccctacatgcccagcgtgatcgagaagatggaggccctgcagcgcaagtacggcggcgcgctggtgcggaacccgctcagccgcaactccacccacgagatgtactgggtcagcaacgcctccgggaacatcgtgagctccgtgaacatgatcagccggatgctgatcaaccgcttcaccatgcggcacaagaaggccacctacgagcccgacgtcgacctgggctccgggacgcgcaacatcggcatcgagagcgagatccccaacctcgacatcatcgggaagcgcatcgagaagatcaagcaggagcacgagacctcctggcactacgaccaggaccacccctacaagacctgggcctaccacggcagctacgagaccaagcagacgggctccgccagctccatggtgaacggggtggtccggctgctgaccaagccgtgggacgtgctccccaccgtgacccagatggcgatgacggacaccacccccttcggccagcagcgcgtcttcaaggagaaggtggacacccggacgcaggagcccaaggaggggaccaagaagctgatgaagatcaccgccgagtggctgtggaaggagctcggcaagaagaagaccccgcgcatgtgcacgcgggaggagttcacccgcaaggtgcggagcaacgccgccctgggcgccatcttcaccgacgagaacaagtggaagtccgcgcgcgaggccgtcgaggacagccggttctgggagctggtggacaaggagcgcaacctccacctggaggggaagtgcgagacctgcgtctacaacatgatgggcaagcgggagaagaagctgggggagttcggcaaggccaaggggtcccgcgccatctggtacatgtggctcggcgcccggttcctggagttcgaggcgctgggcttcctcaacgaggaccactggttcagccgcgagaactccctgagcggggtggagggcgaggggctgcacaagctcggctacatcctgcgggacgtgagcaagaaggagggcggcgccatgtacgccgacgacacggccggctgggacacccgcatcaccctggaggacctcaagaacgaggagatggtcaccaaccacatggagggggagcacaagaagctggcggaggccatcttcaagctgacgtaccagaacaaggtggtgcgggtccagcgccccacgccccggggcaccgtgatggacatcatctcccgccgggaccagcgcgggagcggccaggtggggacctacggcctcaacacgttcaccaacatggaggcccagctgatccgccagatggagggcgagggggtcttcaagaacatccagcacctgaccgtgaccgaggaggtggccgtccagaactggctcgcccgggtgggccgcgagcggctgtcccgcatggcgatcagcggggacgactgcgtggtcaagcccctggacgaccggttcgccaacgccctcacggccctgaacgacatgggcaagatccgcaaggacatccagcagtgggagccgtccaagggctggaacgactggacccaggtgcccttctgcagccaccacttccacgagctgatcatgaaggacgggcgggtgctcgtcgtgccctgccgcaaccaggacgagctgatcggccgggcccgcatctcccagggggcgggctggagcctgcgggagaccgcctgcctcgggaagtcctacgcccagatgtggagcctgatgtacttccaccgccgggacctgcgcctcgccgccaacgcgatctgctccgccgtgcccagccactgggtcccgacctcccggacgacctggagcatccacgccaagcacgagtggatgaccaccgaggacatgctggccgtgtggaaccgcgtgtggatccgggagaacccctggatggaggacaagacccccgtcgagtcctgggaggagatcccctacctgggcaagcgcgaggaccagtggtgcggcagcctcatcgggctgacgtcccgggccacctgggcgaagaacatccaggccgccatcaaccaggtgcgcagcctgatcggcaacgaggagtacaccgactacatgccgagcatgaagcgcttccggcgcgaggaggaggaggccggggtgctctggtga

SEQ ID NO: 9585 - RNA, 9876 nt, synthetic construct
  misc_feature 1..9876: note = derived and/or modified CDS sequence (opt1) from DENV-2__EU482677__SS-prME
  source 1..9876: mol_type = other RNA
agcgccgggatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcgtgaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagacctccaccggcaccatcggggccgtcagcctcgacttctcccccggcacgagcggctcccccatcatcgacaagaaggggaaggtggtgggcctgtacgggaacggcgtcgtgacccgcagcggcgcctacgtgtccgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgtcccccgtgcgggtgccgaactacaacctcatcatcatggacgaggcccacttcaccgaccccgccagcatcgccgcgcgcggctacatcagcacgcgggtcgagatgggcgaggccgccgggatcttcatgaccgccacgccgcccggctcccgcgacccgttcccccagagcaacgcccccatcatcgacgaggagcgggagatccccgagcgctcctggaacagcgggcacgagtgggtgaccgacttcaagggcaagacggtgtggttcgtcccgtccatcaaggcggggaacgacatcgccgcctgcctgcggaagaacggcaagaaggtgatccagctgagccgcaagaccttcgactccgagtacgtgaagaccaagaccaacgactgggacttcgtcgtgacgaccgacatcagcgagatgggcgccaacttcaaggcggagcgggtgatcgacccccgccggtgcatgaagcccgtcatcctcaccgacggggaggagcgcgtgatcctggccggccccatgccggtgacccactccagcgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgtccatgttcgagcccgagcgggagaaggtcgacgccatcgacggcgagtaccgcctgcgcggggaggcccgcaagaccttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctacagcgaccccctcgccctgaaggagttcaaggagttcgccgcgggccggaagtccctgaccctcaacctgatcacggagatgggccgcctgcccaccttcatgacccagaaggcccgggacgccctcgacaacctggccgtgctgcacaccgcggaggccgggggccgcgcctacaaccacgccctcagcgagctgcccgagacgctggagaccctcctgctgctcaccctgctggccaccgtgaccggcgggatcttcctcttcctgatgtccgggcgggggatcggcaagatgaccctggggatgtgctgcatcatcaccgcgagcatcctcctgtggtacgcccagatccagccgcactggatcgccgcctccatcatcctggagttcttcctcatcgtcctgctgatccccgagcccgagaagcagcgcacgccccaggacaaccagctcacctacgtggtgatcgccatcctgacggtcgtggcggccaccatggccaacgagatgggcttcctggagaagaccaagaaggacctcgggctgggcagcatcgccacccagcagccggagtccaacatcctggacatcgacctccggcccgccagcgcgtggacgctgtacgccgtggccaccaccttcgtcacccccatgctgcgccacagcatcgagaactccagcgtgaacgtgtccctcacggccatcgccaaccaggcgaccgtcctgatgggcctggggaagggctggcccctcagcaagatggacatcggggtgccgctgctggccatcggctgctactcccaggtgaaccccatcaccctcaccgccgccctgctgctcctggtcgcgcactacgccatcatcgggcccggcctgcaggccaaggccacgcgggaggcccagaagcgcgcggccgccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggacgacctgggccctctgcgaggccctgaccctggcgaccgggcccatcagcacgctctgggagggcaacccggggcgcttctggaacaccaccatcgccgtctccatggccaacatcttccggggcagctacctggccggcgccgggctcctcttctccatcatgaagaacaccacgaacacccgccggggcaccgggaacatcggcgagaccctgggcgagaagtggaagtcccgcctgaacgcgctcgggaagtccgagttccagacgtacaagaagtccggcatccaggaggtggaccgcaccctggccaaggaggggatcaagcggggcgagaccgaccaccacgccgtgtcccgcgggagcgccaagctgcggtggttcgtcgagcgcaacatggtgacccccgagggcaaggtggtcgacctcggctgcgggcggggcgggtggtcctactactgcggcgggctgaagaacgtgcgcgaggtgaagggcctgacgaagggcgggcccggccacgaggagcccatcccgatgagcacctacgggtggaacctcgtccggctgcagtccggcgtggacgtgttcttcatcccgcccgagaagtgcgacaccctgctctgcgacatcggggagagctcccccaacccgaccgtcgaggcgggccgcacgctgcgggtgctgaacctcgtggagaactggctgaacaacaacacccagttctgcatcaaggtcctgaacccctacatgcccagcgtgatcgagaagatggaggccctgcagcgcaagtacggcggggccctcgtgcggaacccgctgagccgcaactccacccacgagatgtactgggtcagcaacgcctccggcaacatcgtgagctccgtgaacatgatcagccggatgctgatcaaccgcttcaccatgcggcacaagaaggccacctacgagcccgacgtcgacctcgggtccggcacgcgcaacatcgggaacgagagcgagatccccaacctggacatcatcggcaagcggatcgagaagatcaagcaggagcacgagacctcctggcactacgaccaggaccacccctacaagacctgggcgtaccacggcagctacgagaccaagcagacggggtccgccagctccatggtgaacggcgtggtccgcctgctcaccaagccgtgggacgtgctgcccaccgtgacccagatggccatgacggacaccacccccttcgggcagcagcgggtcttcaaggagaaggtggacacccgcacgcaggagcccaaggagggcaccaagaagctgatgaagatcaccgccgagtggctctggaaggagctgggcaagaagaagaccccgcgcatgtgcacgcgggaggagttcacccgcaaggtgcggagcaacgccgcgctgggggccatcttcaccgacgagaacaagtggaagtccgcccgcgaggccgtcgaggacagccggttctgggagctcgtggacaaggagcgcaacctgcacctggagggcaagtgcgagacctgcgtctacaacatgatggggaagcgggagaagaagctcggcgagttcgggaaggccaagggctcccgcgcgatctggtacatgtggctgggcgcccggttcctggagttcgaggccctcgggttcctgaacgaggaccactggttcagccgcgagaactccctgagcggcgtggagggggagggcctccacaagctggggtacatcctgcgggacgtgagcaagaaggagggcggcgccatgtacgcggacgacacggccgggtgggacacccgcatcaccctcgaggacctgaagaacgaggagatggtcaccaaccacatggagggcgagcacaagaagctggccgaggccatcttcaagctcacgtaccagaacaaggtggtgcgggtccagcgccccacgccccgggggaccgtgatggacatcatctcccgccgggaccagcgcggcagcggccaggtggggacctacggcctgaacacgttcaccaacatggaggcccagctgatccggcagatggagggggagggcgtcttcaagaacatccagcacctcaccgtgaccgaggaggtggcggtccagaactggctggcccgcgtggggcgggagcgcctgtcccgcatggccatcagcggcgacgactgcgtggtcaagcccctcgacgaccggttcgccaacgccctgacggcgctgaacgacatgggcaagatccgcaaggacatccagcagtgggagccgtccaaggggtggaacgactggacccaggtgcccttctgcagccaccacttccacgagctcatcatgaaggacggccgggtgctggtcgtgccctgccgcaaccaggacgagctgatcgggcgggcccgcatctcccagggcgccgggtggagcctccgggagaccgcctgcctgggcaagtcctacgcccagatgtggagcctgatgtacttccaccgccgggacctccgcctggcggccaacgccatctgctccgccgtgcccagccactgggtcccgacctcccggacgacctggagcatccacgccaagcacgagtggatgaccaccgaggacatgctgaccgtgtggaaccgcgtgtggatccgggagaacccctggatggaggacaagacgcccgtcgagtcctgggaggagatcccctacctcggcaagcgcgaggaccagtggtgcgggagcctgatcggcctgacctcccgggcgacctgggccaagaacatccaggtggccatcaaccaggtgcgcagcctcatcgggaacgaggagtacaccgactacatgccgagcatgaagcggttccgccgggaggaggaggaggccggcgtcctgtggtga

SEQ ID NO: 9586 - RNA, 9876 nt, synthetic construct
  misc_feature 1..9876: note = derived and/or modified CDS sequence (opt1) from DENV-2__EU482678__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacgagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcgcggtgtccttcgtgaccctgatcaccggcaacatgagcttcaaggacctcgggcgggtcgtggtgatggtcggcgccacgatggccgacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcgccatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaacaccgggcacgagtgggtcacggacttcaagggcaagaccgtgtggttcgtgccgtccatcaaggcggggaacgacatcgccgcctgcctgcggaagaacggcaagaaggtcatccagctgagccgcaagaccttcgactccgagtacgtgaagacccggacgaacgactgggacttcgtggtcaccaccgacatcagcgagatgggcgccaacttcaaggcggagcgcgtgatcgacccccggcgctgcatgaagcccgtgatcctcaccgacggggaggagcgggtcatcctggccggccccatgccggtgacgcactccagcgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctacagcgaccccctcgccctgaaggagttcaaggagttcgccgcgggccgcaagtccctgacgctcaacctgatcaccgagatgggccggctgcccaccttcatgacccagaagacgcgcgacgccctcgacaacctggccgtcctgcacaccgccgaggccggcgggcgggcctacaaccacgccctcagcgagctgcccgagaccctggagaccctcctgctgctcacgctgctggccaccgtgaccgggggcatcttcctcttcctgatgtccggccgcgggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgaccatggccaacgagatgggcttcctggagaagacgaagaaggacctcgggctgggcagcatcgccacccagcagccggagtccaacatcctggacatcgacctccgccccgccagcgcctggaccctgtacgcggtggccaccacgttcgtgacccccatgctgcggcactccatcgagaacagcagcgtcaacgtgtccctcaccgccatcgccaaccaggccaccgtgctgatgggcctggggaagggctggcccctcagcaagatggacatcggggtcccgctgctggcgatcggctgctactcccaggtgaaccccatcacgctcaccgccgccctgctgctcctggtggcccactacgcgatcatcgggcccggcctgcaggccaaggccacccgcgaggcccagaagcgggccgcggccggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatcagcaccctctgggagggcaacccggggcggttctggaacaccacgatcgcggtgtccatggccaacatcttccgcggcagctacctggccggcgccgggctcctcttctccatcatgaagaacaccaccaacacccggcgcggcacggggaacatcggcgagaccctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgtcccgggggagcgccaagctgcgctggttcgtggagcggaacatggtcacgcccgagggcaaggtggtggacctcggctgcgggcgcggcgggtggtcctactactgcggcgggctgaagaacgtccgggaggtgaagggcctgaccaagggcgggcccggccacgaggagcccatcccgatgagcacctacgggtggaacctcgtgcgcctgcagtccggcgtcgacgtgttcttcatcccgcccgagaagtgcgacaccctgctctgcgacatcggggagagctcccccaacccgacggtggaggccggccggaccctgcgcgtcctgaacctcgtggagaactggctgaacaacaacacccagttctgcatcaaggtgctgaacccctacatgcccagcgtcatcgagaagatggaggcgctgcagcggaagtacggcggggccctcgtgcgcaacccgctgtcccggaacagcacccacgagatgtactgggtgagcaacgcctccggcaacatcgtcagctccgtgaacatgatcagccgcatgctgatcaaccggttcaccatgcgccacaagaaggccacgtacgagcccgacgtggacctcgggtccggcacccggaacatcgggatcgagagcgagatccccaacctggacatcatcggcaagcgcatcgagaagatcaagcaggagcacgagacctcctggcactacgaccaggaccacccctacaagacctgggcctaccacggcagctacgagacgaagcagaccgggtccgcgagctccatggtcaacggcgtggtgcggctgctcaccaagccgtgggacgtcctgcccaccgtgacgcagatggccatgaccgacaccacccccttcgggcagcagcgcgtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgcagcaacgccgccctgggggcgatcttcaccgacgagaacaagtggaagtccgcccgggaggccgtggaggacagccgcttctgggagctcgtcgacaaggagcggaacctgcacctggagggcaagtgcgagacgtgcgtgtacaacatgatggggaagcgcgagaagaagctcggcgagttcgggaaggccaagggctcccgggccatctggtacatgtggctgggcgcgcgcttcctggagttcgaggccctcgggttcctgaacgaggaccactggttcagccgggagaactccctgagcggcgtcgagggggagggcctccacaagctggggtacatcctgcgcgacgtgtccaagaaggagggcggcgccatgtacgccgacgacaccgcggggtgggacacccggatcaccctcgaggacctgaagaacgaggagatggtgacgaaccacatgaagggcgagcacaagaagctggccgaggccatcttcaagctcacctaccagaacaaggtcgtgcgcgtgcagcggcccacgccccgggggaccgtcatggacatcatcagccggcgcgaccagcggggcagcggccaggtggggacgtacggcctgaacaccttcaccaacatggaggcccagctgatccgccagatggagggggagggcgtgttcaagaacatccagcacctcaccgtcacggaggaggtggccgtgcagaactggctggcgcgggtcgggcgcgagcgcctgtcccggatggccatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtgcccagccactgggtgccgacgtcccgcaccacctggagcatccacgccaagcacgagtggatgaccaccgaggacatgctgacggtctggaaccgggtgtggatccgcgagaacccctggatggaggacaagacccccgtggagtcctgggaggagatcccctacctcggcaagcgggaggaccagtggtgcgggagcctgatcggcctgacctcccgcgccacctgggcgaagaacatccaggccgccatcaaccaggtccggagcctcatcgggaacgaggagtacacggactacatgccgtccatgaagcgcttccggcgcgaggaggaggaggccggcgtgctgtggtga

SEQ ID NO: 9587 - RNA, 9876 nt, synthetic construct
  misc_feature 1..9876: note = derived and/or modified CDS sequence (opt1) from DENV-2__EU482679__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccatccgggtcccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtctggttcgtgccgagcatcaaggcggggaacgacatcgccgcctgcctgcggaagaacggcaagaaggtgatccagctgtcccgcaagaccttcgacagcgagtacgtcaagacccggaccaacgactgggacttcgtggtgacgaccgacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtcaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtggtcatcgccatcctgaccgtggtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtcgccaccaccttcgtgacgcccatgctgcggcacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcaccctcacggccgccctgctgctcctggtggcccactacgcgatcatcgggcccggcctgcaggccaaggccacccgcgaggcccagaagcgggccgcggccggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgacgaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgaccgtggaggccggccggacgctgcgcgtgctgaacctcgtcgagaactggctgaacaacaacacccagttctgcatcaaggtgctgaacccctacatgccctccgtgatcgagaagatggaggcgctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggcaagaagaagaccccgcggatggggacgcgcgaggagttcacccggaaggtccgctccaacgccgccctgggcgcgatcttcaccgacgagaacaagtggaagtccgcccgggaggccgtggaggactcccgcttctgggagctcgtggacaaggagcggaacctgcacctggaggggaagtgcgagacctgcgtctacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgtccggggtggagggcgaggggctccacaagctgggctacatcctgcgcgacgtcagcaagaaggagggcggggccatgtacgccgacgacacggcgggctgggacacccggatcaccctcgaggacctgaagaacgaggagatggtgaccaaccacatggagggggagcacaagaagctggccgaggccatcttcaagctcacgtaccagaacaaggtggtccgcgtgcagcggcccacgccccggggcaccgtgatggacatcatcagccggcgcgaccagcgggggtccggccaggtcggcacctacgggctgaacacgttcaccaacatggaggcccagctgatccgccagatggagggcgagggggtgttcaagaacatccagcacctcaccgtgaccgaggaggtcgccgtgcagaactggctggcgcgggtgggccgcgagcgcctgagccggatggccatctccggcgacgactgcgtcgtgaagcccctcgacgaccgcttcgccaacgccctgacggccctgaacgacatggggaagatccggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcgggaagcgggaggaccagtggtgcggctccctgatcgggctgaccagccgcgccacctgggcgaagaacatccaggccgccatcaaccaggtgcggtccctcatcggcaacgaggagtacaccgactacatgccgagcatgaagcgcttccggcgcgaggaggaggaggccggggtcctgtggtga

SEQ ID NO: 9588 - RNA, 9876 nt, synthetic construct
  misc_feature 1..9876: note = derived and/or modified CDS sequence (opt1) from DENV-2__EU482774__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcttcatcggggtgatcatcacctggatcggcatgaactcccggagcacctccctgagcgtctccctggtgctggtggggatcgtcacgctctacctgggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctcgccagcgcgatccagaaggcccaggaggaggggatctgcggcatccgctccgtcacgcggctggagaacctgatgtggaagcagatcacccccgagctcaaccacatcctggccgagaacgaggtgaagctgaccatcatgaccggggacatcaagggcatcatgcaggccgggaagcgcagcctccggccgcagcccacggagctgaagtactcctggaagacctggggcaaggccaagatgctgagcaccgagtcccacaaccagaccttcctcatcgacggccccgagacggcggagtgcccgaacaccaaccgcgcctggaacagcctggaggtggaggactacgggttcggcgtcttcaccaccaacatctggctgaagctcaaggagaagcaggacgccttctgcgactccaagctgatgagcgccgccatcaaggacaaccgggcggtgcacgccgacatggggtactggatcgagtccgccctgaacgacacgtggaagatcgagaaggccagcttcatcgaggtgaagaactgccactggcccaagtcccacaccctctggagcaacggcgtcctggagtccgagatgatcatccccaagaacctggccggccccgtgagccagcacaactaccgcccggggtaccacacccagatcgcgggcccctggcacctcgggaagctggagatggacttcgacttctgcgacggcaccaccgtgatcgtcacggaggactgcgggaaccggggcccctccctgcgcaccaccaccgccagcggcaagctcatcacggagtggtgctgccggagctgcaccctgcccccgctgcgctaccgcggggaggacggctgctggtacgggatggagatccgccccctcaaggagaaggaggagaacctggtgaactccctggtgaccgccggccacgggcaggtcgacaacttcagcctcggcgtgctgggcatggccctgttcctcgaggagatgctgcggacccgcgtggggacgaagcacgcgatcctgctcgtcgccgtgtccttcgtgaccctgatcaccggcaacatgagcttcaaggacctggggcgggtcgtggtgatggtcggcgccaccatggccgacgacatcgggatgggcgtgacgtacctcgccctgctggcggccttcaaggtgcgccccaccttcgccgccggcctcctgctgcggaagctcacctccaaggagctgatgatgaccacgatcgggatcgtcctgctcagccagtccaccatccccgagaccgtgctggagctgaccgacgccctcgcgctgggcatgatggtgctgaagatcgtccgcaacatggagaagtaccagctcgccgtgacgatcatggccatcctgtgcgtcccgaacgccgtggtgctgcagaacgcctggaaggtcagctgcaccatcctcgcggtggtgtccgtcagccccctgctgctcacctccagccagcagaagaccgactggatccccctggccctgacgatcaaggggctcaaccccaccgccatcttcctgaccaccctgtcccgcacgaacaagaagcggagctggccgctcaacgaggccatcatggcggtgggcatggtgtccatcctggccagctccctgctcaagaacgacatccccatgaccggccccctggtcgccgggggcctgctcaccgtgtgctacgtgctgaccgggcgcagcgccgacctggagctcgagcgggccacggacgtcaagtgggaggaccaggcggagatctccggcagcagccccatcctgtccatcaccatcagcgaggacgggtccatgagcatcaagaacgaggaggaggagcagaccctgaccatcctcatccgcacgggcctgctggtgatctccggcctcttcccgatcagcatccccatcaccgccgccgcctggtacctgtgggaggtgaagaagcagcgggccggggtcctgtgggacgtgcccagcccgccgcccatgggcaaggcggagctcgaggacggggcctaccgcatcaagcagaagggcatcctggggtacagccagatcggcgccggcgtgtacaaggaggggaccttccacaccatgtggcacgtcacccggggcgccgtgctgatgcacaaggggaagcgcatcgagccctcctgggccgacgtgaagaaggacctcatcagctacggcgggggctggaagctggagggcgagtggaaggagggggaggaggtccaggtgctggcgctcgagcccggcaagaacccccgggccgtgcagacgaagcccgggctgttcaagaccaacaccggcaccatcggggccgtctccctggacttcagccccggcacgtccggcagccccatcatcgacaagaaggggaaggtggtgggcctctacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctgcccgccatcgtccgggaggccatcaagcgcgggctccggaccctgatcctggcgccgacccgcgtggtggccgccgagatggaggaggccctccggggcctgcccatccgctaccagacccccgccatcaaggcggagcacacggggcgggagatcgtcgacctgatgtgccacgccaccttcaccatgcgcctcctgagccccgtgcgcgtgccgaactacaacctgatcatcatggacgaggcccacttcaccgaccccgcctccatcgccgcgcggggctacatcagcacgcgcgtcgagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtgtggttcgtcccgagcatcaaggcggggaacgacatcgccgcctgcctccgcaagaacggcaagaaggtgatccagctgtcccggaagaccttcgacagcgagtacgtgaagacccgcaccaacgactgggacttcgtcgtgacgaccgacatctccgagatgggcgccaacttcaaggcggagcgggtgatcgacccccgccggtgcatgaagcccgtcatcctgaccgacggggaggagcgcgtgatcctcgccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacgcccgagggcatcatcccgagcatgttcgagcccgagcgggagaaggtcgacgccatcgacggcgagtaccgcctgcgcggggaggcccgcaagaccttcgtggacctgatgcgccggggcgacctccccgtgtggctggcctacaaggtcgccgcggaggggatcaactacgccgaccgccggtggtgcttcgacggcatcaagaacaaccagatcctggaggagaacgtggaggtcgagatctggaccaaggagggggagcgcaagaagctcaagccgcggtggctggacgcccgcatctactccgaccccctggccctcaaggagttcaaggagttcgccgcgggccggaagtccctgaccctgaacctcatcacggagatgggccgcctgcccaccttcatgacccagaagacccgggacgccctggacaacctcgccgtgctgcacacggccgaggccggcgggcgcgcctacaaccacgccctgtccgagctccccgagaccctggagaccctgctcctgctgaccctcctggccacggtgaccgggggcatcttcctgttcctcatgagcggccgggggatcggcaagatgaccctggggatgtgctgcatcatcaccgcctccatcctgctctggtacgcgcagatccagccgcactggatcgccgccagcatcatcctggagttcttcctgatcgtcctcctgatccccgagcccgagaagcagcgcacgccccaggacaaccagctgacgtacgtggtgatcgccatcctcaccgtcgtggccgcgaccatggccaacgagatgggcttcctggagaagaccaagaaggacctggggctcggctccatcgccacgcagcagccggagagcaacatcctggacatcgacctgcggcccgcctccgcctggaccctctacgcggtggccaccaccttcgtcacgcccatgctgcgccacagcatcgagaacagctccgtgaacgtgagcctgaccgccatcgccaaccaggccaccgtcctcatgggcctggggaagggctggcccctgtccaagatggacatcggggtgccgctcctggcgatcggctgctacagccaggtgaaccccatcaccctgacggccgccctcctgctgctcgtcgcccactacgcgatcatcgggcccggcctgcaggccaaggccacccgggaggcccagaagcgcgccgcggccggcatcatgaagaaccccaccgtggacgggatcaccgtgatcgacctggacccgatcccctacgaccccaagttcgagaagcagctcggccaggtcatgctgctgatcctctgcgtgacccaggtgctgatgatgcggaccacctgggccctgtgcgaggccctcaccctggccacggggcccatctccaccctgtgggagggcaacccggggcgcttctggaacaccaccatcgcggtcagcatggccaacatcttccggggctcctacctcgccggcgccgggctgctgttcagcatcatgaagaacacgaccaacacccgccggggcaccgggaacatcggcgagacgctcggcgagaagtggaagtcccgcctgaacgccctgggcaagagcgagttccagatctacaagaagtccggcatccaggaggtggaccgcaccctcgcgaaggaggggatcaagcggggcgagaccgaccaccacgccgtgagccgcgggtccgccaagctgcggtggttcgtcgagcgcaacatggtgacccccgagggcaaggtggtcgacctgggctgcgggcggggcgggtggagctactactgcggcgggctcaagaacgtgcgcgaggtgaagggcctgacgaagggcgggcccggccacgaggagcccatcccgatgtccacctacgggtggaacctggtccggctccagagcggcgtggacgtgttcttcatcccgcccgagaagtgcgacaccctgctgtgcgacatcggggagtccagccccaacccgaccgtcgaggccggccgcacgctccgggtgctgaacctggtggagaactggctcaacaacaacacccagttctgcatcaaggtcctgaacccctacatgccctccgtgatcgagaagatggaggcgctgcagcgcaagtacggcggggccctggtgcggaacccgctcagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctggggagcggcacgcgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagaccaagcagacggggagcgcgtccagcatggtgaacggcgtggtccgcctgctgaccaagccgtgggacgtgctccccaccgtgacccagatggccatgacggacaccacccccttcgggcagcagcgggtcttcaaggagaaggtggacacccgcacgcaggagcccaaggagggcaccaagaagctgatgaagatcaccgccaagtggctgtggaaggagctcggcaagaagaagaccccgcgcatgtgcacgcgggaggagttcacccgcaaggtgcggtccaacgccgccctgggggcgatcttcaccgacgagaacaagtggaagtccgcccgcgaggccgtcgaggactcccggttctgggagctggtggacaaggagcgcaacctccacctggagggcaagtgcgagacctgcgtctacaacatgatggggaagcgggagaagaagctgggcgagttcgggaaggccaagggcagccgcgccatctggtacatgtggctcggcgcgcggttcctggagttcgaggccctggggttcctcaacgaggaccactggttctcccgcgagaacagcctgtccggcgtggagggggagggcctgcacaagctcgggtacatcctgcgggacgtgagcaagaaggagggcggcgccatgtacgccgacgacacggcggggtgggacacccgcatcaccctggaggacctcaagaacgaggagatggtcaccaaccacatggagggcgagcacaagaagctggccgaggccatcttcaagctgacgtaccagaacaaggtggtgcgggtccagcgccccacgccccgggggaccgtgatggacatcatcagccgccgggaccagcgcggctccggccaggtggggacctacggcctcaacacgttcaccaacatggaggcccagctgatccggcagatggagggggagggcgtcttcaagaacatccagcacctgaccgtgaccgaggaggtggccgtccagaactggctcgcgcgcgtggggcgggagcgcctgagccgcatggccatctccggcgacgactgcgtggtcaagcccctggacgaccggttcgccaacgccctcacggccctgaacgacatgggcaagatccgcaaggacatccagcagtgggagccgagcaaggggtggaacgactggacccaggtgcccttctgctcccaccacttccacgagctgatcatgaaggacggccgggtgctcgtcgtgccctgccgcaaccaggacgagctgatcgggcgggcgcgcatcagccagggcgccgggtggtccctgcgggagaccgcctgcctcggcaagagctacgcccagatgtggtccctgatgtacttccaccgccgggacctgcgcctcgccgcgaacgccatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctgggcaagcgcgaggaccagtggtgcgggtccctcatcggcctgaccagccgggccacctgggcgaagaacatccaggccgccatcaaccaggtgcgctccctgatcgggaacgaggagtacaccgactacatgccgagcatgaagcggttccgccgggaggaggaggaggccggcgtgctctggtga

SEQ ID NO: 9589 - RNA, 9876 nt, synthetic construct
  misc_feature 1..9876: note = derived and/or modified CDS sequence (opt1) from DENV-2__EU482775__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgcgcaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgcgcggagcacacggggcgggagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccgcctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccgccggggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgggtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtgggcacctacggcctgaacacgttcaccaacatggaggcccagctgatccgccagatggagggggagggcgtgttcaagaacatccagcacctcaccgtcaccgaggaggtggccgtgcacaactggctggcgcgcgtcgggcgggagcgcctgagccggatggccatctccggcgacgactgcgtggtgaagcccctcgacgaccgcttcgccaacgccctgacggccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacaccgactacatgccgagcatgaagcgcttccgccgggaggaggaggaggccggcgtgctgtggtga

SEQ ID NO: 9590 - RNA, 9876 nt, synthetic construct
  misc_feature 1..9876: note = derived and/or modified CDS sequence (opt1) from DENV-2__EU482776__SS-prME
  source 1..9876: mol_type = other RNA
agcgccgggatgatcatcatgctgatccccaccgtgatggccttccacctcaccacccgcaacggggagccccacatgatcgtggggatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggcctacaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggcgagctgcaccatcctggccgtggtctccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggcgatcatggccgtgggcatggtctccatcctggccagctccctcctgaagaacgacatccccatgaccggccccctggtggccgggggcctcctgaccgtgtgctacgtcctgaccgggcggagcgccgacctcgagctggagcgcgcgacggacgtgaagtgggaggaccaggccgagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtcaagaagcagcgcgcgggggtgctctgggacgtgcccagcccgccgcccatgggcaaggccgagctggaggacggggcctaccggatcaagcagaagggcatcctggggtacagccagatcggcgccggcgtctacaaggaggggaccttccacaccatgtggcacgtgacccgcggcgccgtgctcatgcacaaggggaagcggatcgagccctcctgggcggacgtcaagaaggacctgatcagctacggcgggggctggaagctggagggcgagtggaaggagggggaggaggtccaggtgctcgccctggagcccggcaagaacccccgcgccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccggtccggcgcctacgtcagcgcgatcgcccagaccgagaagtccatcgaggacaaccccgagatcgaggacgacatcttccgcaagcggcgcctgaccatcatggacctgcaccccggggccggcaagacgaagcggtacctccccgccatcgtgcgcgaggcgatcaagcgggggctgcgcaccctgatcctcgccccgacccgggtggtcgccgccgagatggaggaggccctgcgcggcctgcccatccggtaccagacccccgcgatccgcgccgagcacacggggcgcgagatcgtggacctcatgtgccacgccaccttcaccatgcggctgctgagccccgtgcgcgtcccgaactacaacctcatcatcatggacgaggcccacttcaccgaccccgcctccatcgcggcccggggctacatcagcacgcgcgtggagatgggcgaggccgccgggatcttcatgaccgccacgccgcccggcagccgggacccgttcccccagtccaacgcgcccatcatcgacgaggagcgcgagatccccgagcggagctggaactccgggcacgagtgggtgaccgacttcaagggcaagacggtctggttcgtgccgagcatcaaggccgggaacgacatcgccgcctgcctgcgcaagaacggcaagaaggtgatccagctgtcccggaagaccttcgacagcgagtacgtcaagacccgcaccaacgactgggacttcgtggtgacgaccgacatctccgagatgggcgcgaacttcaaggccgagcgggtcatcgacccccgccggtgcatgaagcccgtgatcctcaccgacggggaggagcgcgtgatcctggccggccccatgccggtcacccacagctccgccgcccagcggcgcgggcggatcggccgcaaccccaagaacgagaacgaccagtacatctacatgggggagcccctggagaacgacgaggactgcgcgcactggaaggaggccaagatgctcctggacaacatcaacacgcccgagggcatcatcccgagcatgttcgagcccgagcgggagaaggtggacgccatcgacggcgagtaccgcctgcgcggggaggcccggaagaccttcgtggacctcatgcgccggggcgacctgcccgtctggctggcctacaaggtggcggccgaggggatcaactacgccgaccgccggtggtgcttcgacggcatcaagaacaaccagatcctcgaggagaacatggaggtggagatctggaccaaggagggggagcgcaagaagctgaagccgcggtggctggacgcccgcatctactccgaccccctcgccctgaaggagttcaaggagttcgcggccggccggaagtccctgaccctcaacctgatcacggagatgggccgcctgcccaccttcatgacccagaagacccgggacgccctcgacaacctggccgtcctgcacacggcggaggccgggggccgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcgtccatcctcctgtggtacgcccagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggcggccaccatggccaacgagatgggcttcctggagaagaccaagaaggacctcgggctgggctccatcgccacgcagcagccggagagcaacatcctggacatcgacctccggcccgcctccgcgtggaccctgtacgccgtggccaccaccttcgtcacgcccatgctgcgccacagcatcgagaacagctccgtgaacgtgagcctcaccgccatcgccaaccaggcgaccgtcctgatgggcctggggaagggctggcccctctccaagatggacatcggggtgccgctgctggccatcggctgctacagccaggtgaaccccatcaccctcacggccgccctgctgctcctggtcgcgcactacgccatcatcgggcccggcctgcaggccaaggccacccgggaggcccagaagcgcgcggccgccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggaccacctgggccctctgcgaggccctgaccctggcgacggggcccatctccaccctctgggagggcaacccggggcgcttctggaacaccaccatcgccgtcagcatggccaacatcttccggggctcctacctggccggcgccgggctcctcttcagcatcatgaagaacacgaccaacacccgccgcggcaccgggaacatcggcgagacgctgggcgagaagtggaagtcccggctgaacgcgctcggcaagagcgagttccagatctacaagaagtccggcatccaggaggtggaccgcaccctggccaaggaggggatcaagcggggcgagaccgaccaccacgccgtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgacgaagggcgggcccggccacgaggagcccatcccgatgtccacctacgggtggaacctcgtccggctgcagagcggcgtggacgtgttcttcatcccgcccgagaagtgcgacaccctgctctgcgacatcggggagtccagccccaacccgaccgtcgaggcgggccgcacgctgcggatcctgaacctcgtggagaactggctgaacaacaacacccagttctgcatcaaggtgctgaacccctacatgccctccgtcatcgagaagatggaggccctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgaggcgagctggcactacgaccaggaccacccctacaagacctgggcctaccacggctcctacgagaccaagcagaccgggagcgcctccagcatggtcaacggcgtggtgcgcctgctcacgaagccgtgggacgtcctgcccaccgtgacccagatggccatgaccgacacgacccccttcgggcagcagcgcgtgttcaaggagaaggtcgacacccggacccaggagcccaaggagggcacgaagaagctgatgaagatcaccgccgagtggctctggaaggagctgggcaagaagaagaccccgcgcatgtgcacccgggaggagttcacgcgcaaggtgcggtccaacgcggccctgggggccatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggcgaagggcagccgcgccatctggtacatgtggctgggcgcccggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgcgatgtacgccgacgacaccgccgggtgggacacgcgcatcaccctcgaggacctgaagaacgaggagatggtgaccaaccacatggagggcgagcacaagaagctggccgaggccatcttcaagctcacctaccagaacaaggtcgtgcgggtgcagcgccccacgccccgggggaccgtcatggacatcatcagccgccgggaccagcgcggctccggccaggtgggcacctacggcctgaacaccttcacgaacatggaggcgcagctgatccggcagatggagggggagggcgtgttcaagaacatccagcacctcaccgtcaccgaggaggtggccgtgcacaactggctggcccgcgtcgggtgcgagcgcctgagccggatggccatctccggcgacgactgcgtggtgaagcccctcgacgaccgcttcgccaacgcgctgaccgccctgaacgacatgggcaagatccggaaggacatccagcagtgggagccgagcaaggggtggaacgactggacgcaggtccccttctgctcccaccacttccacgagctcatcatgaaggacggccgcgtgctggtggtcccctgccggaaccaggacgagctgatcgggcgcgcccggatcagccagggcgccgggtggtccctccgcgagaccgcctgcctgggcaagagctacgcgcagatgtggtccctgatgtacttccaccggcgcgacctccggctggccgccaacgccatctgcagcgccgtgccctcccactgggtgccgaccagccgcaccacgtggtccatccacgcgaagcacgagtggatgaccaccgaggacatgctgaccgtctggaaccgggtgtggatcctcgagaacccctggatggaggacaagacccccgtggagagctgggaggagatcccctacctgggcaagcgcgaggaccagtggtgcgggtccctgatcggcctcacgagccgggccacctgggccaagaacatccaggccgcgatcaaccaggtccgctccctgatcgggaacgaggagtacaccgactacatgccgagcatgaagcggttccgccgggaggaggaggaggccggcgtgctgtggtga

SEQ ID NO: 9591 - RNA, 9876 nt, synthetic construct
  misc_feature 1..9876: note = derived and/or modified CDS sequence (opt1) from DENV-2__EU482777__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggtggccgtgcagaactggctggcgcgggtcgggcgcgagcgcctgagccggatggccatctccggcgacgactgcgtggtgaagcccctcgacgaccgcttcgccaacgccctgacggccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacaccgactacatgccgagcatgaagcgcttccggcgcgaggaggaggaggccggcgtgctgtggtga

SEQ ID NO: 9592 - RNA, 9876 nt, synthetic construct
  misc_feature 1..9876: note = derived and/or modified CDS sequence (opt1) from DENV-2__EU482778__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatcagcaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcgggggcgtgttcaccagcatcgggaaggccctccaccaggtcttcggcgccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtgaagaactgccactggcccaagagccacaccctgtggtccaacggcgtcctggagagcgagatgatcatccccaagtccttcgccgggccggtgagccagcacaactaccgccccggctactacacccagaccgccgggccctggcacctcggcaagctggagatggacttcgacttctgcgaggggacgaccgtggtcgtgaccgaggactgcggcaaccggggcccctccctgcgcaccacgaccgccagcgggaagctcatcaccgagtggtgctgccggagctgcaccctgccgcccctgcgctaccggggcgaggacgggtgctggtacggcatggagatccgccccctcaaggagaaggaggagaacctggtgaactccctggtcacggcggggcacggccagatcgacaacttcagcctcggcgtgctggggatggccctgttcctcgaggagatgctgcggacccgcgtgggcaccaagcacgccatcctgctcgtcgccgtgtccttcgtgaccctgatcacggggaacatgagcttccgggacctgggccgcgtcatggtgatggtgggggccgcgatgaccgacgacatcggcatcggcgtcacctacctcgccctgctggccgccttcaaggtgcgccccaccttcgccgcggggctcctgctgcggaagctcacgtccaaggagctgatgatggccaccatcggcatcgccctgctcagccagtccaccatcccggagaccatcctggagctgacggacgccctcgccctggggatgatggtgctgaagatcgtccgcaacatggagaagtaccagctcgcggtgaccatcatggccatcagctgcgtgcccaacgccgtcatcctgcagaacgcctggaaggtgtcctgcaccatcctggcgaccgtgagcgtcagccccctcctgctgacgagctcccagcagaaggccgactggatccccctcgccctgaccatcaagggcctgaacccgaccgccatcttcctcaccacgctgagccggacctccaagaagcgcagctggcccctgaacgaggccatcatggcggtgggcatggtctccatcctcgccagctccctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatcagcgggtccagcccgatcctctccatcaccatcgccgaggacggcagcatgtccatcaagaacgaggaggaggagcagaccctgacgatcctgatccggaccggcctcctggtgatcagcgggctgttccccgtctccatccccatcaccgccgccgcctggtacctctgggaggtgaagaagcagcgcgcgggcgtgctgtgggacgtccccagcccgccgcccgtggggaaggccgagctggaggacggcgcctaccggatcaagcagaaggggatcctcggctactcccagatcggcgccggggtgtacaaggagggcaccttccacaccatgtggcacgtcacgcgcggggccgtgctgatgcaccggggcaagcgcatcgagccgagctgggcggacgtgaagaaggacctgatctcctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtcagcctggacttctccccgggcaccagcgggtcccccatcgtggacaagaagggcaaggtggtcgggctgtacggcaacggcgtggtgacccgcagcggggcgtacgtctccgccatcgcccagaccgagaagtccatcgaggacaaccccgagatcgaggacgacatcttccggaagaagcgcctcacgatcatggacctgcaccccggcgccgggaagaccaagcggtacctgccggccatcgtgcgcgaggcgatcaagcggggcctgcgcaccctcatcctggcccccacccgggtggtcgccgccgagatggaggaggccctgcgcgggctccccatccgctaccagacgcccgcgatccgggccgagcacaccggccgcgagatcgtggacctgatgtgccacgccaccttcaccatgcggctgctctccccggtgcgcgtccccaactacaacctgatcatcatggacgaggcccacttcacggaccccgccagcatcgcggcccggggctacatcagcacccgcgtggagatgggggaggccgccggcatcttcatgaccgcgacgccgcccgggtcccgggaccccttcccccagagcaacgcccccatcatggacgaggagcgcgagatccccgagcggtcctggaacagcggccacgagtgggtgacggacttcaaggggaagaccgtctggttcgtgccctccatcaaggccggcaacgacatcgccgcctgcctgcgcaagaacggcaagaaggtgatccagctcagccggaagaccttcgactccgagtacgtcaagacccgcacgaacgactgggacttcgtggtgaccaccgacatcagcgagatgggggcgaacttcaaggccgagcgggtcatcgacccccgccggtgcatgaagcccgtgatcctgaccgacggcgaggagcgcgtgatcctggccgggccgatgcccgtcacgcactccagcgccgcccagcggcgcggccggatcgggcgcaaccccaagaacgagaacgaccagtacatctacatgggcgagcccctcgagaacgacgaggactgcgcgcactggaaggaggccaagatgctgctggacaacatcaacaccccggagggcatcatcccctccatgttcgagcccgagcgcgagaaggtggacgccatcgacggggagtaccggctccgcggcgaggcccggaagaccttcgtggacctgatgcgccgcggggacctgccggtctggctcgcctaccgcgtggcggccgagggcatcaactacgccgaccggcgctggtgcttcgacggggtgaagaacaaccagatcctggaggagaacgtcgaggtggagatctggaccaaggagggcgagcggaagaagctgaagccccgctggctcgacgcccggatctacagcgaccccctggcgctgaaggagttcaaggagttcgccgccggccgcaagtccctcacgctgaacctgatcaccgagatggggcggctccccaccttcatgacccagaaggcccgcgacgccctggacaacctggcggtgctccacacggccgaggccggcgggcgggcctacaaccacgccctgagcgagctgccggagaccctcgagaccctgctgctcctgaccctgctcgcgacggtcaccggcggcatcttcctgttcctgatgtccgggaagggcgtggggaagatgaccctcggcatgtgctgcatcatcaccgccagcatcctgctgtggcacgcccagatccagccccactggatcgccgcctccatcatcctcgagttcttcctgatcgtcctgctcatccccgagcccgagaagcagcgcaccccgcaggacaaccagctgacgtacgtggtgatcgcgatcctgaccgtcgtggccgccaccatggccaacgagatggggttcctcgagaagaccaagaaggacctgggcctgggcagcatcgccacgcaggagcccgagtccaacatcctcgacatcgacctgcggcccgcgagcgcctggaccctgtacgccgtggccaccaccttcgtcacgcccatgctccgccacagcatcgagaactccagcgtgaacgtgtccctgaccgcgatcgccaaccaggccaccgtcctgatggggctcggcaaggggtggccgctgagcaagatggacatcggcgtgcccctgctcgccatcgggtgctactcccaggtgaaccccatcaccctgacggccgcgctgctcctgctggtcgcccactacgccatcatcggccccggcctccaggccaaggccacccgggaggcgcagaagcgcgccgccgccgggatcatgaagaacccgaccgtggacggcatcaccgtgatcgacctggaccccatcccctacgaccccaagttcgagaagcagctggggcaggtcatgctcctgatcctgtgcgtgacccaggtgctcatgatgcggaccacctgggccctgtgcgaggcgctgaccctcgccacgggcccgatcagcaccctgtgggaggggaaccccggccgcttctggaacaccaccatcgccgtctccatggccaacatcttccgcggcagctacctggcgggggccggcctcctgttctccatcatgaagaacacgaccaacacccggcgcgggaccggcaacatcggcgagacgctgggggagaagtggaagtcccggctcaacgccctgggcaagtccgagttccagatctacaagaagtccgggatccaggaggtggaccgcaccctggccaaggagggcatcaagcgcggggagaccgaccaccacgccgtgtcccgcggcagcgcgaagctccggtggttcgtcgagcgcaacatggtgacccccgagggcaaggtggtcgacctggggtgcggccgcgggggctggtcctactactgcgggggcctgaagaacgtgcgcgaggtgaagggcctcacgaagggcggccccgggcacgaggagccggtccccatgagcacctacggctggaacctggtgcggctgcagtccggggtggacgtcttcttcacgccgcccgagaagtgcgacaccctcctgtgcgacatcggcgagagctccccgaaccccacgatcgaggccggccgcaccctgcgggtgctcagcctggtggagaactggctgaacaacgacacccagttctgcatcaaggtcctcaacccctacatgccgagcgtgatcgagaagatggagaccctgcagcgcaagtacgggggcgccctggtgcggaaccccctgtcccgcaacagcacccacgagatgtactgggtctccaacgccacggggaacatcgtgagctccgtgaacatgatcagccggatgctcatcaaccgcttcaccatgaagcacaagaaggccacctacgagcccgacgtcgacctgggctccgggacccggaacatcggcatcgagagcgagatccccaacctggacatcatcggcaagcgcatcgagaagatcaagcaggagcacgagacgtcctggcactacgaccaggaccacccgtacaagacctgggcgtaccacgggagctacgagaccaagcagaccggctccgccagctccatggtgaacggggtggtccgcctcctgacgaagccctgggacgtggtgcccatggtcacccagatggccatgaccgacaccacgcccttcggccagcagcgggtgttcaaggagaaggtggacacccgcacccaggagccgaaggagggcaccaagaagctgatgaagatcacggccgagtggctctggaaggagctggggaagaagaagacgccccggatgtgcacccgcgaggagttcacccggaaggtccgcagcaacgccgcgctgggcgccatcttcacggacgagaacaagtggaagtccgcccgggaggccgtggaggacagccgcttctgggagctcgtggacaaggagcggaacctgcacctggaggggaagtgcgagacctgcgtctacaacatgatgggcaagcgcgagaagaagctcggggagttcggcaaggcgaagggctcccgggccatctggtacatgtggctgggggcccgcttcctggagttcgaggccctcggcttcctgaacgaggaccactggttcagccgggagaactccctgagcggggtggagggcgaggggctccacaagctgggctacatcctgcgcgacgtcagcaagaaggagggcggggccatgtacgcggacgacaccgccggctgggacacccggatcacgctcgaggacctgaagaacgaggagatggtgaccaaccacatggagggggagcacaagaagctggccgaggccatcttcaagctcacctaccagaacaaggtggtccgcgtgcagcggcccacgccccggggcacggtgatggacatcatctcccggcgcgaccagcgggggagcggccaggtcggcacctacgggctgaacaccttcaccaacatggaggcccagctgatccgccagatggagggcgaggggatcttcaagtccatccagcacctcacggtgaccgaggagatcgcggtgcagaactggctggcccgcgtcggccgggagcgcctgagccggatggccatctccggcgacgactgcgtggtgaagccgctcgacgaccgcttcgccagcgccctgaccgcgctgaacgacatggggaaggtccggaaggacatccagcagtgggagccctcccgcggctggaacgactggacccaggtgcccttctgcagccaccacttccacgagctcatcatgaaggacgggcgggtgctggtcgtgccctgccgcaaccaggacgagctgatcggccgggcccgcatctcccagggggccggctggagcctcaaggagacggcctgcctgggcaagtcctacgcccagatgtggagcctgatgtacttccaccggcgcgacctccggctggcggccaacgccatctgctccgccgtgccgagccactgggtccccacctcccgcaccacctggagcatccacgcgaagcacgagtggatgaccacggaggacatgctgaccgtgtggaaccgggtgtggatccaggagaacccctggatggaggacaagacccccgtcgagtcctgggaggaggtgccgtacctcgggaagcgcgaggaccagtggtgcggcagcctgatcgggctgaccagccgggccacgtgggccaagaacatccagaccgccatcaaccaggtgcgctccctcatcggcaacgaggagtacaccgactacatgcccagcatgaagcggttccgccgcgaggaggaggaggccggggtcctgtggtga

SEQ ID NO: 9593 - RNA, 9876 nt, synthetic construct
  misc_feature 1..9876: note = derived and/or modified CDS sequence (opt1) from DENV-2__EU482779__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgcgctgctggccgccttcaaggtgcgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggggcgaacttcaaggccgagcgcgtcatcgacccccggcgctgcatgaagcccgtgatcctgaccgacggcgaggagcgggtgatcctggccgggccgatgcccgtcacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgggagaaggtggacgccatcgacggggagtaccgcctccggggcgaggcccgcaagaccttcgtggacctgatgcggcgcggggacctgccggtctggctcgcctaccgggtggcggccgagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcccgcatctactccgaccccctggcgctgaaggagttcaaggagttcgccgccggccgcaagagcctcacgctgaacctgatcaccgagatggggcgcctccccaccttcatgacccagaaggcccgggacgccctggacaacctggcggtgctccacacggccgaggccggcgggcgcgcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggtacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgcgaggcgcagaagcgggccgccgccgggatcatgaagaacccgaccgtggacggcgtgaccgtcatcgacctggaccccatcccctacgaccccaagttcgagaagcagctgggccaggtgatgctcctgatcctgtgcgtgacgcaggtcctcatgatgcgcaccacctgggccctgtgcgaggcgctgaccctcgccacgggcccgatctccaccctgtgggaggggaaccccggccgcttctggaacaccaccatcgccgtgagcatggccaacatcttccggggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtcagccggggctccgcgaagctccgctggttcgtggagcggaacatggtgacccccgagggcaaggtcgtggacctggggtgcggccgcgggggctggagctactactgcgggggcctgaaggacgtgcgggaggtcaagggcctcacgaagggcgggcccgggcacgaggagccgatccccatgtccacctacggctggaacctggtgcgcctgcagagcggggtggacgtcttcttcacgccgcccgagaagtgcgacaccctcctgtgcgacatcggcgagtccagcccgaaccccacgatcgaggccggccggaccctgcgcgtgctcagcctggtggagaactggctgaacaacgacacccagttctgcatcaaggtcctcaacccctacatgccgtccgtgatcgagaagatggagaccctgcagcggaagtacgggggcgccctggtgcgcaaccccctgagccggaactccacccacgagatgtactgggtcagcaacgccacggggaacatcgtgtccagcgtgaacatgatctcccgcatgctcatcaaccggttcaccatgaagcacaagaaggccacctacgagcccgacgtcgacctgggcagcgggacccgcaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtgaacggggtggtccggctcctgacgaagccctgggacgtggtgcccatggtcacccagatggccatgaccgacaccacgcccttcggccagcagcgcgtgttcaaggagaaggtggacacccggacccaggagccgaaggagggcaccaagaagctgatgaagatcacggccgagtggctctggaaggagctggggaagaagaagacgccccggatgtgcacccgggaggagttcacccgcaaggtccggtccaacgccgcgctgggcgccatcttcacggacgagaacaagtggaagtccgcccgcgaggccgtggaggactcccggttctgggagctcgtggacaaggagcgcaacctgcacctggaggggaagtgcgagacctgcgtctacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtggagggcgaggggctccacaagctgggctacatcctgcgggacgtctccaagaaggagggcggggccatgtacgcggacgacaccgccggctgggacacccgcatcacgctcgaggacctgaagaacgaggagatggtgaccaaccacatggagggggagcacaagaagctggccgaggccatcttcaagctcacctaccagaacaaggtggtccgggtgcagcgccccacgccccggggcacggtgatggacatcatcagccgccgggaccagcgcgggtccggccaggtcggcacctacgggctgaacaccttcaccaacatggaggcccagctgatccgccagatggagggcgagggggtgttcaagagcatccagcggctcacggtgaccgaggagatcgcggtccagaactggctggcccgcgtgggccgggagcgcctgtcccggatggccatcagcggcgacgactgcgtggtcaagccgctcgacgaccgcttcgcctccgccctgaccgcgctgaacgacatggggaaggtgcggaaggacatccagcagtgggagcccagccgcggctggaacgactggacccaggtgcccttctgctcccaccacttccacgagctcatcatgaaggacgggcgggtcctggtggtgccctgccgcaaccaggacgagctgatcggccgggcccgcatcagccagggggccggctggtccctcaaggagacggcctgcctgggcaagagctacgcccagatgtggtccctgatgtacttccaccggcgcgacctccggctggcggccaacgccatctgcagcgccgtcccgtcccactgggtgcccaccagccgcaccacctggtccatccacgcgaagcacgagtggatgaccacggaggacatgctgaccgtgtggaaccgggtctggatccaggagaacccctggatggaggacaagacccccgtggagagctgggaggaggtgccgtacctcgggaagcgcgaggaccagtggtgcggcagcctgatcgggctgacctcccgggccacgtgggccaagaacatccagaccgccatcaaccaggtccgcagcctcatcggcaacgaggagtacaccgactacatgccctccatgaagcgcttccggcgcgaggaggaggaggccggggtgctgtggtga

SEQ ID NO: 9594 - RNA, 9876 nt, synthetic construct
  misc_feature 1..9876: note = derived and/or modified CDS sequence (opt1) from DENV-2__EU482780__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgcgctgctggccgccttcaaggtgcgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggggcgaacttcaaggccgagcgcgtcatcgacccccggcgctgcatgaagcccgtgatcctgaccgacggcgaggagcgggtgatcctggccgggccgatgcccgtcacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgggagaaggtggacgccatcgacggggagtaccgcctccggggcgaggcccgcaagaccttcgtggacctgatgcggcgcggggacctgccggtctggctcgcctaccgggtggcggccgagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcccgcatctactccgaccccctggcgctgaaggagttcaaggagttcgccgccggccgcaagagcctcacgctgaacctgatcaccgagatggggcgcctccccaccttcatgacccagaaggcccgggacgccctggacaacctggcggtgctccacacggccgaggccggcgggcgcgcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggtacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgcgaggcgcagaagcgggccgccgccgggatcatgaagaacccgaccgtggacggcgtgaccgtcatcgacctggaccccatcccctacgaccccaagttcgagaagcagctgggccaggtgatgctcctgatcctgtgcgtgacgcaggtcctcatgatgcgcaccacctgggccctgtgcgaggcgctgaccctcgccacgggcccgatctccaccctgtgggaggggaaccccggccgcttctggaacaccaccatcgccgtgagcatggccaacatcttccggggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtcagccggggctccgcgaagctccgctggttcgtggagcggaacatggtgacccccgagggcaaggtcgtggacctggggtgcggccgcgggggctggagctactactgcgggggcctgaaggacgtgcgggaggtcaagggcctcacgaagggcgggcccgggcacgaggagccgatccccatgtccacctacggctggaacctggtgcgcctgcagagcggggtggacgtcttcttcacgccgcccgagaagtgcgacaccctcctgtgcgacatcggcgagtccagcccgaaccccacgatcgaggccggccggaccctgcgcgtgctcagcctggtggagaactggctgaacaacgacacccagttctgcatcaaggtcctcaacccctacatgccgtccgtgatcgagaagatggagaccctgcagcggaagtacgggggcgccctggtgcgcaaccccctgagccggaactccacccacgagatgtactgggtcagcaacgccacggggaacatcgtgtccagcgtgaacatgatctcccgcatgctcatcaaccggttcaccatgaagcacaagaaggccacctacgagcccgacgtcgacctgggcagcgggacccgcaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtgaacggggtggtccggctcctgacgaagccctgggacgtggtgcccatggtcacccagatggccatgaccgacaccacgcccttcggccagcagcgcgtgttcaaggagaaggtggacacccggacccaggagccgaaggagggcaccaagaagctgatgaagatcacggccgagtggctctggaaggagctggggaagaagaagacgccccggatgtgcacccgggaggagttcacccgcaaggtccggtccaacgccgcgctgggcgccatcttcacggacgagaacaagtggaagtccgcccgcgaggccgtggaggactcccggttctgggagctcgtggacaaggagcgcaacctgcacctggaggggaagtgcgagacctgcgtctacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtggagggcgaggggctccacaagctgggctacatcctgcgggacgtctccaagaaggagggcggggccatgtacgcggacgacaccgccggctgggacacccgcatcacgctcgaggacctgaagaacgaggagatggtgaccaaccacatggagggggagcacaagaagctggccgaggccatcttcaagctcacctaccagaacaaggtggtccgggtgcagcgccccacgccccggggcacggtgatggacatcatcagccgccgggaccagcgcgggtccggccaggtcggcacctacgggctgaacaccttcaccaacatggaggcccagctgatccgccagatggagggcgagggggtgttcaagagcatccagcggctcacggtgaccgaggagatcgcggtccagaactggctggcccgcgtgggccgggagcgcctgtcccggatggccatcagcggcgacgactgcgtggtcaagccgctcgacgaccgcttcgcctccgccctgaccgcgctgaacgacatggggaaggtgcggaaggacatccagcagtgggagcccagccgcggctggaacgactggacccaggtgcccttctgctcccaccacttccacgagctcatcatgaaggacgggcggatgctggtcgtgccctgccgcaaccaggacgagctgatcggccgggcccgcatcagccagggggccggctggtccctcaaggagacggcctgcctgggcaagagctacgcccagatgtggtccctgatgtacttccaccggcgcgacctccggctggcggccaacgccatctgcagcgccgtgccgtcccactgggtccccaccagccgcaccacctggtccatccacgcgaagcacgagtggatgaccacggaggacatgctgaccgtgtggaaccgggtgtggatccaggagaacccctggatggaggacaagacccccgtcgagagctgggaggaggtgccgtacctcgggaagcgcgaggaccagtggtgcggcagcctgatcgggctgacctcccgggccacgtgggccaagaacatccagaccgccatcaaccaggtgcgcagcctcatcggcaacgaggagtacaccgactacatgccctccatgaagcgcttccggcgcgaggaggaggaggccggggtcctgtggtga

SEQ ID NO: 9595 - RNA, 9876 nt, synthetic construct
  misc_feature 1..9876: note = derived and/or modified CDS sequence (opt1) from DENV-2__EU482781__SS-prME
  source 1..9876: mol_type = other RNA
accgccggcgtgatcatcatgctgatccccaccgccatggcgttccacctcaccacccgcaacggggagccgcacatgatcgtcggccggcaggagaagggcaagagcctgctgttcaagaccgaggacggggtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcagcccggcaagcggtccctgcgcccccagccgaccgagctgaagtacagctggaagacctggggcaaggccaagatgctctccaccgagagccacaaccagacgttcctgatcgacgggcccgagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgccgcgatcaaggacaaccgggccgtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatcccgaagtccttcgcggggcccgtgtcccagcacaactaccgccccggctactacacccagaccgccgggccctggcacctcggcaagctggagatggacttcgacttctgcgaggggacgaccgtggtcgtgaccgaggactgcggcaaccggggcccgagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggccgggcacggccagatcgacaacttctccctcggcgtgctggggatggcgctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgccctgctggcggccttcaaggtgcgcccgacgttcgccgccgggctcctgctgcggaagctcaccagcaaggagctgatgatggccaccatcggcatcgcgctgctctcccagagcaccatccccgagacgatcctggagctgaccgacgccctcgccctggggatgatggtgctgaagatcgtccgcaacatggagaagtaccagctcgccgtgaccatcatggccatctcctgcgtgcccaacgcggtcatcctgcagaacgcctggaaggtgagctgcaccatcctggccgccgtgtccgtcagccccctcctgctgacgtccagccagcagaaggcggactggatcccgctcgccctgaccatcaagggcctgaaccccaccgccatcttcctcaccacgctgtcccggaccagcaagaagcgctcctggcccctgaacgaggccatcatggccgtgggcatggtcagcatcctcgcgtccagcctgctgaagaacgacatccccatgaccgggccgctcgtggccggcgggctgctgaccgtgtgctacgtcctcacgggccggagcgccgacctggagctggagcgcgccaccgacgtgaagtgggaggaccaggccgagatctccgggagctcccccatcctcagcatcaccatcgcggaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgccggcgtgctgtgggacgtcccgagcccgccgcccgtggggaaggcggagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccctcctgggccgacgtgaagaaggacctgatcagctacgggggcggctggaagctcgagggggagtggaaggagggcgaggaggtccaggtgctggcgctggagcccgggaagaacccccgggccgtgcagaccaagcccggcctcttcaagaccaacaccgggacgatcggcgccgtctccctggacttcagccccggcacctccgggagccccatcgtggaccgcaagggcaaggtggtcgggctgtacggcaacggcgtggtgacccggtccggggcctacgtcagcgcgatcgcccagaccgagaagtccatcgaggacaaccccgagatcgaggacgacatcttccgcaagaagcggctcacgatcatggacctgcacccgggcgccgggaagaccaagcgctacctgcccgccatcgtgcgggaggccatcaagcgcggcctgcggaccctcatcctggcgcccacccgcgtggtcgccgccgagatggaggaggccctgcgcgggctccccatccggtaccagacgccggccatccgcgcggagcacaccggccgggagatcgtggacctgatgtgccacgccaccttcaccatgcgcctgctcagccccgtgcgggtccccaactacaacctgatcatcatggacgaggcccacttcacggaccccgccagcatcgccgcgcgcggctacatctccacccgggtggagatgggggaggccgccggcatcttcatgaccgccaccccgcccgggagccgcgaccccttcccccagtccaacgcgccgatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggggccaacttcaaggcggagcgcgtcatcgacccccggcgctgcatgaagccggtgatcctgaccgacggcgaggagcgggtgatcctggccgggcccatgcccgtcacgcacagctccgccgcccagcgccggggccgcatcgggcgcaaccccaagaacgagaacgaccagtacatctacatgggcgagccgctcgagaacgacgaggactgcgcccactggaaggaggcgaagatgctgctggacaacatcaacacccccgagggcatcatccccagcatgttcgagccggagcgggagaaggtggacgccatcgacggggagtaccgcctccggggcgaggcccgcaagaccttcgtggacctgatgcggcgcggggacctgcccgtctggctcgcctaccgggtggccgcggagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcccgcatctactccgaccccctggccctgaaggagttcaaggagttcgcggccggccgcaagagcctcacgctgaacctgatcaccgagatggggcgcctcccgaccttcatgacccagaaggcccgggacgccctggacaacctggccgtgctccacacggcggaggccggcgggcgcgcctacaaccacgccctgtccgagctgcccgagaccctcgagaccctgctgctcctgaccctgctcgccacggtcaccggcggcatcttcctgttcctgatgagcgggaagggcgtggggaagatgaccctcggcatgtgctgcatcatcaccgcgtccatcctgctgtggtacgcccagatccagccccactggatcgccgccagcatcatcctcgagttcttcctgatcgtcctgctcatccccgagccggagaagcagcggacgccccaggacaaccagctgacgtacgtggtgatcgccatcctgaccgtcgtggcggccaccatggccaacgagatggggttcctcgagaagaccaagaaggacctgggcctgggctccatcgccacgcaggagcccgagagcaacatcctcgacatcgacctgcgccccgccagcgcgtggaccctgtacgccgtggccaccaccttcgtcacgccgatgctccggcactccatcgagaacagctccgtgaacgtgagcctgaccgccatcgcgaaccaggccaccgtcctgatggggctcggcaaggggtggcccctgtccaagatggacatcggcgtgcccctgctcgccatcgggtgctacagccaggtgaaccccatcaccctgacggccgccctgctcctgctggtcgcgcactacgccatcatcggcccgggcctccaggccaaggccacccgcgaggcccagaagcgggcggccgccgggatcatgaagaaccccaccgtggacggcgtgaccgtcatcgacctggaccccatcccctacgacccgaagttcgagaagcagctgggccaggtgatgctcctgatcctgtgcgtgacgcaggtcctcatgatgcgcaccacctgggccctgtgcgaggccctgaccctcgcgacgggccccatctccaccctgtgggaggggaaccccggccgcttctggaacaccaccatcgccgtgagcatggccaacatcttccggggctcctacctggccggggcgggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtcagccggggctccgccaagctccgctggttcgtggagcggaacatggtgacccccgagggcaaggtcgtggacctggggtgcggccgcgggggctggagctactactgcgggggcctgaaggacgtgcgggaggtcaagggcctcacgaagggcggcccggggcacgaggagcccatccccatgtccacctacggctggaacctggtgcgcctgcagagcggggtggacgtcttcttcacgccgcccgagaagtgcgacaccctcctgtgcgacatcggcgagtccagccccaaccccacgatcgaggcgggccggaccctgcgcgtgctcagcctggtggagaactggctgaacaacgacacccagttctgcatcaaggtcctcaacccctacatgccctccgtgatcgagaagatggagaccctgcagcggaagtacgggggcgccctggtgcgcaaccccctgagccggaactccacccacgagatgtactgggtcagcaacgccacggggaacatcgtgtccagcgtgaacatgatctcccgcatgctcatcaaccggttcaccatgaagcacaagaaggccacctacgagcccgacgtcgacctgggcagcgggacccgcaacatcggcatcgagtccgagatcccgaacctggacatcatcggcaagcgcatcgagaagatcaagcaggagcacgagacgagctggcactacgaccaggaccacccctacaagacctgggcctaccacgggtcctacgagaccaagcagaccggcagcgcgtccagcatggtgaacggggtggtccggctcctgacgaagccctgggacgtggtgcccatggtcacccagatggccatgaccgacaccacgccgttcggccagcagcgcgtgttcaaggagaaggtggacacccggacccaggagcccaaggagggcaccaagaagctgatgaagatcacggccgagtggctctggaaggagctggggaagaagaagacgccccggatgtgcacccgggaggagttcacccgcaaggtccggtccaacgccgccctgggcgcgatcttcacggacgagaacaagtggaagtccgcccgcgaggccgtggaggactcccggttctggaagctcgtggacaaggagcgcaacctgcacctggaggggaagtgcgagacctgcgtctacaacatgatgggcaagcgggagaagaagctcggggagttcggcaaggccaagggcagccgcgcgatctggtacatgtggctgggggcccggttcctggagttcgaggccctcggcttcctgaacgaggaccactggttctcccgcgagaacagcctgagcggggtggagggcgaggggctccacaagctgggctacatcctgcgggacgtctccaagaaggagggcggggccatgtacgccgacgacaccgcgggctgggacacccgcatcacgctcgaggacctgaagaacgaggagatggtgaccaaccacatggagggggagcacaagaagctggccgaggccatcttcaagctcacctaccagaacaaggtggtccgggtgcagcgccccaccccgcggggcacggtgatggacatcatcagccgccgggaccagcgcgggtccggccaggtcggcacctacgggctgaacaccttcaccaacatggaggcccagctgatccgccagatggagggcgagggggtgttcaagagcatccagcggctcacggtgaccgaggagatcgccgtccagaactggctggcgcgcgtgggccgggagcgcctgtcccggatggccatcagcggcgacgactgcgtggtcaagcccctcgacgaccgcttcgcctccgccctgaccgccctgaacgacatggggaaggtgcggaaggacatccagcagtgggagcccagccgcggctggaacgactggacccaggtgcccttctgctcccaccacttccacgagctcatcatgaaggacgggcgggtcctggtggtgccgtgccgcaaccaggacgagctgatcggccgggcgcgcatcagccagggggccggctggtccctcaaggagacggcctgcctgggcaagagctacgcccagatgtggtccctgatgtacttccaccggcgcgacctccggctggccgcgaacgccatctgcagcgccgtcccctcccactgggtgcccaccagccgcaccacctggtccatccacgccaagcacgagtggatgaccacggaggacatgctgaccgtgtggaaccgggtctggatccaggagaacccctggatggaggacaagaccccggtggagagctgggaggaggtgccctacctcgggaagcgcgaggaccagtggtgcggcagcctgatcgggctgacctcccgggcgacgtgggccaagaacatccagaccgccatcaaccaggtccgcagcctcatcggcaacgaggagtacaccgactacatgccctccatgaagcgcttccggcgcgaggaggaggaggccggggtgctgtggtga

SEQ ID NO: 9596 - RNA, 9876 nt, synthetic construct
  misc_feature 1..9876: note = derived and/or modified CDS sequence (opt1) from DENV-2__EU482782__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgtcgccggcctgctgctccgcaagctgacctccaaggagctgatgatgaccacgatcgggatcgtgctcctgagccagtccaccatccccgagaccgtgctggagctcaccgacgccctggccctgggcatgatggtcctcaagatcgtgcgcaacatggagaagtaccagctggcggtcacgatcatggccatcctgtgcgtgccgaacgccgtgatcctccagaacgcctggaaggtcagctgcaccatcctggccgtggtgtccgtcagccccctgctcctgacctccagccagcagaagaccgactggatccccctggcgctcacgatcaaggggctgaaccccaccgccatcttcctgaccaccctctcccggacgaacaagaagcgcagctggccgctgaacgaggccatcatggccgtgggcatggtgtccatcctggcgagctccctcctgaagaacgacatccccatgaccggccccctggtcgccgggggcctcctgaccgtgtgctacgtgctgaccgggcggagcgccgacctcgagctggagcgcgccacggacgtcaagtgggaggaccaggccgagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgcggccgcctggtacctgtgggaggtgaagaagcagcgcgccggggtcctctgggacgtgcccagcccgccgcccatgggcaaggccgagctggaggacggggcgtaccggatcaagcagaagggcatcctggggtacagccagatcggcgccggcgtgtacaaggaggggaccttccacaccatgtggcacgtcacccgcggcgccgtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgcggtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccggtccggcgcctacgtgagcgccatcgcccagaccgagaagtccatcgaggacaaccccgagatcgaggacgacatcttccgcaagcggcgcctgaccatcatggacctgcaccccggggcgggcaagacgaagcggtacctccccgccatcgtccgcgaggccatcaagcgggggctgcgcaccctgatcctcgccccgacccgggtggtggcggccgagatggaggaggccctgcgcggcctgcccatccggtaccagacccccgccatccgcgccgagcacacggggcgcgagatcgtcgacctcatgtgccacgcgaccttcaccatgcggctgctgagccccgtgcgcgtgccgaactacaacctcatcatcatggacgaggcccacttcaccgaccccgcctccatcgccgcccggggctacatcagcacgcgcgtcgagatgggcgaggcggccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtgtggttcgtcccgagcatcaaggccgggaacgacatcgcggcctgcctgcgcaagaacggcaagaaggtgatccagctgtcccggaagaccttcgacagcgagtacgtgaagacccgcaccaacgactgggacttcgtcgtgacgaccgacatctccgagatgggcgccaacttcaaggccgagcgggtgatcgacccccgccggtgcatgaagcccgtcatcctcaccgacggggaggagcgcgtgatcctggcgggccccatgccggtgacccacagctccgccgcccagcggcgcgggcggatcggccgcaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgggagaaggtcgacgcgatcgacggcgagtaccgcctgcgcggggaggcccggaagaccttcgtggacctcatgcgccggggcgacctgcccgtgtggctggcctacaaggtcgccgccgaggggatcaactacgcggaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgccggccggaagtccctgaccctcaacctgatcacggagatgggccgcctgcccaccttcatgacccagaagacccgggacgcgctcgacaacctggccgtgctgcacacggccgaggccgggggccgcgcgtacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcccagatccagccgcactggatcgcggccagcatcatcctggagttcttcctcatcgtcctgctgatccccgagcccgagaagcagcgcacgccccaggacaaccagctcacgtacgtggtgatcgccatcctgaccgtcgtggccgccaccatggcgaacgagatgggcttcctggagaagaccaagaaggacctcgggctgggctccatcgccacgcagcagccggagagcaacatcctggacatcgacctccggcccgcctccgcctggaccctgtacgccgtggcgaccaccttcgtcacgcccatgctgcgccacagcatcgagaacagctccgtgaacgtgagcctcaccgccatcgccaaccaggccaccgtcctgatgggcctggggaagggctggcccctctccaagatggacatcggggtgccgctgctggccatcggctgctacagccaggtgaaccccatcaccctcacggcggccctgctgctcctggtcgcccactacgccatcatcgggcccggcctgcaggcgaaggccacccgggaggcccagaagcgcgccgccgcgggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggaccacctgggccctctgcgaggccctgaccctggccacggggcccatctccaccctctgggagggcaacccggggcgcttctggaacaccaccatcgccgtcagcatggcgaacatcttccggggctcctacctggccggcgccgggctcctcttcagcatcatgaagaacacgaccaacacccgccgcggcaccgggaacatcggcgagacgctgggcgagaagtggaagtcccggctgaacgccctcggcaagagcgagttccagatctacaagaagtccggcatccaggaggtggaccgcaccctggccaaggaggggatcaagcggggcgagaccgaccaccacgcggtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgacgaagggcgggcccggccacgaggagcccatcccgatgtccacctacgggtggaacctcgtccggctgcagagcggcgtggacgtgttcttcatcccgcccgagaagtgcgacaccctgctctgcgacatcggggagtccagccccaacccgaccgtcgaggccggccgcacgctgcgggtgctgaacctcgtggagaactggctgaacaacaacacccagttctgcatcaaggtcctgaacccctacatgccctccgtgatcgagaagatggaggccctgcagcgcaagtacggcggggcgctcgtgcggaacccgctgagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtggtccgcctgctcaccaagccgtgggacgtgctgcccaccgtgacccagatggcgatgacggacaccacccccttcgggcagcagcgcgtcttcaaggagaaggtggacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggccatcttcaccgacgagaacaagtggaagtccgcgcgcgaggccgtcgaggactcccggttctgggagctcgtggacaaggagcgcaacctgcacctggagggcaagtgcgagacctgcgtctacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtggagggggagggcctccacaagctggggtacatcctgcgggacgtgagcaagaaggagggcggcgccatgtacgccgacgacacggccgggtgggacacccgcatcaccctcgaggacctgaagaacgaggagatggtcaccaaccacatggagggcgagcacaagaagctggcggaggccatcttcaagctcacgtaccagaacaaggtggtgcgggtccagcgccccacgccccgggggaccgtgatggacatcatcagccgccgggaccagcgcggctccggccaggtgggcacctacggcctgaacacgttcaccaacatggaggcccagctgatccggcagatggagggggagggcgtcttcaagaacatccagcacctcaccgtgaccgaggaggtggccgtccacaactggctggcccgcgtggggcgcgagcggctgagccgcatggcgatctccggcgacgactgcgtggtcaagcccctcgacgaccggttcgccaacgccctgacggccctgaacgacatgggcaagatccgcaaggacatccagcagtgggagccgagcaaggggtggaacgactggacccaggtgcccttctgctcccaccacttccacgagctcatcatgaaggacggccgggtgctggtcgtgccctgccgcaaccaggacgagctgatcgggcgggcccgcatcagccagggcgcggggtggtccctccgggagaccgcctgcctgggcaagagctacgcccagatgtggtccctgatgtacttccaccgccgggacctccgcctggccgccaacgcgatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcggcaagcgcgaggaccagtggtgcgggtccctgatcggcctgaccagccgggccacctgggccaagaacatccaggcggccatcaaccaggtgcgctccctcatcgggaacgaggagtacaccgactacatgccgagcatgaagcggttccgccgcgaggaggaggaggccggcgtgctgtggtga

SEQ ID NO: 9597 - RNA, 9876 nt, synthetic construct
  misc_feature 1..9876: note = derived and/or modified CDS sequence (opt1) from DENV-2__EU482783__SS-prME
  source 1..9876: mol_type = other RNA
accgccggggtgatcatcatgctgatccccaccgccatggcgttccacctcaccacccggaacggggagccccacatgatcgtcgggcggcaggagaagggcaagagcctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgggatcaagggcatcatgcaggccggcaagcggtccctgcgcccccagcccaccgagctgaagtacagctggaagacctgggggaaggccaagatgctctccaccgagagccacaaccagacgttcctgatcgacggcccggagaccgccgagtgccccaacaccaaccgggcctggaactccctggaggtggaggactacgggttcggcgtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggggtgctggagtccgagatgatcatccccaagagcttcgccggcccggtgtcccagcacaactaccgccccgggtactacacccagaccgccggcccctggcacctcgggaagctggagatggacttcgacttctgcgagggcacgaccgtggtcgtgaccgaggactgcggcaaccgggggcccagcctgcgcaccacgaccgccagcggcaagctcatcaccgagtggtgctgccggtcctgcaccctgccgcccctgcgctaccgcggggaggacggctgctggtacgggatggagatccgccccctcaaggagaaggaggagaacctggtgaacagcctggtcacggcgggccacggccagatcgacaacttctccctcggggtgctgggcatggccctgttcctcgaggagatgctgcggacccgcgtggggaccaagcacgccatcctgctcgtcaccgtgagcttcgtgacgctgatcaccggcaacatgtccttccgggacctggggcgcgtcatggtgatggtgggcgccgccatgaccgacgacatcggcatgggggtcacctacctcgcgctgctggccgccttcaaggtgcgccccacgttcgccgccggcctcctgctgcggaagctcaccagcaaggagctgatgatggcgaccatcgggatcgccctgctctcccagagcaccatcccggagacgatcctggagctgaccgacgccctcgccctgggcatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtggggatggtcagcatcctcgcctccagcctgctgaagaacgacatccccatgaccggccccctcgtggccgggggcctgctgaccgtgtgctacgtcctcacggggcggagcgccgacctggagctggagcgcgccaccgacgtgaagtgggaggaccaggcggagatctccggcagctccccgatcctcagcatcaccatcgccgaggacggctccatgagcatcaagaacgaggaggaggagcagaccctgacgatcctgatccggaccgggctcctggtgatctccggcctgttccccgtcagcatccccatcaccgccgccgcctggtacctctgggaggtgaagaagcagcgcgcgggggtgctgtgggacgtcccctccccgccgcccgtgggcaaggccgagctggaggacggggcctaccggatcaagcagaagggcatcctcggctacagccagatcggggccggcgtgtacaaggaggggaccttccacaccatgtggcacgtcacgcgcggcgccgtgctgatgcaccgggggaagcgcatcgagccgtcctgggcggacgtgaagaaggacctgatcagctacggcggcgggtggaagctcgagggcgagtggaaggagggggaggaggtccaggtgctggccctggagcccggcaagaacccccgggccgtgcagaccaagcccggcctcttcaagaccaacaccggcacgatcggcgccgtctccctggacttcagcccggggacctccggcagccccatcgtggaccgcaaggggaaggtggtcggcctgtacggcaacggggtggtgacccggtccggcgcgtacgtcagcgccatcgcccagaccgagaagtccatcgaggacaaccccgagatcgaggacgacatcttccgcaagaagcggctcacgatcatggacctgcaccccggggccggcaagaccaagcgctacctgccggccatcgtgcgggaggcgatcaagcgcgggctgcggaccctcatcctggcccccacccgcgtggtcgccgccgagatggaggaggccctgcgcggcctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcgggtacatctccacccgggtggagatgggcgaggccgccgggatcttcatgaccgcgacgccgcccggcagccgcgaccccttcccccagtccaacgcccccatcatggacgaggagcgggagatccccgagcgcagctggaactccgggcacgagtgggtgacggacttcaagggcaagaccgtctggttcgtgcccagcatcaaggccggcaacgacatcgccgcctgcctgcggaagaacgggaagaaggtgatccagctctcccgcaagaccttcgacagcgagtacgtcaagacccggacgaacgactgggacttcgtggtgaccaccgacatctccgagatgggcgcgaacttcaaggccgagcgcgtcatcgacccccggcgctgcatgaagcccgtgatcctgaccgacggggaggagcgggtgatcctggccggcccgatgcccgtcacgcacagctccgccgcccagcgccgggggcgcatcggccgcaaccccaagaacgagaacgaccagtacatctacatgggcgagcccctcgagaacgacgaggactgcgcgcactggaaggaggccaagatgctgctggacaacatcaacaccccggaggggatcatccccagcatgttcgagcccgagcgggagaaggtggacgccatcgacggcgagtaccgcctccgcggggaggcccgcaagaccttcgtggacctgatgcggcgcggcgacctgccggtctggctcgcctaccgggtggcggccgaggggatcaactacgccgaccgccggtggtgcttcgacggcgtgaagaacaaccagatcctggaggagaacgtcgaggtggagatctggaccaaggagggcgagcgcaagaagctgaagccccggtggctcgacgcccgcatctactccgaccccctggcgctgaaggagttcaaggagttcgccgccgggcgcaagagcctcacgctgaacctgatcaccgagatgggccgcctccccaccttcatgacccagaaggcccgggacgccctggacaacctggcggtgctccacacggccgaggccgggggccgcgcctacaaccacgccctgtccgagctgccggagaccctcgagaccctgctgctcctgaccctgctcgcgacggtcaccggcgggatcttcctgttcctgatgagcggcaagggggtgggcaagatgaccctcgggatgtgctgcatcatcaccgcctccatcctgctgtggtacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatgggcttcctcgagaagaccaagaaggacctgggcctggggtccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatgggcctcgggaagggctggccgctgtccaagatggacatcggggtgcccctgctcgccatcggctgctacagccaggtgaaccccatcaccctgacggccgcgctgctcctgctggtcgcccactacgccatcatcggccccgggctccaggccaaggccacccgcgaggcgcagaagcgggccgccgccggcatcatgaagaacccgaccgtggacgggatcaccgtgatcgacctggaccccatcccctacgaccccaagttcgagaagcagctgggccaggtcatgctcctgatcctgtgcgtgacccaggtgctcatgatgcgcaccacctgggccctgtgcgaggcgctgaccctcgccacggggccgatctccaccctgtgggagggcaaccccggccgcttctggaacaccaccatcgccgtcagcatggccaacatcttccgggggtcctacctggcgggcgccgggctcctgttcagcatcatgaagaacacgaccaacacccgccggggcaccggcaacatcggggagacgctgggcgagaagtggaagtcccgcctcaacgccctgggcaagagcgagttccagatctacaagaagtccggcatccaggaggtggaccggaccctggccaaggaggggatcaagcgcggcgagaccgaccaccacgccgtgagccggggctccgcgaagctccgctggttcgtcgagcggaacatggtgacccccgaggggaaggtggtcgacctgggctgcgggcgcggcgggtggagctactactgcggcggcctgaaggacgtgcgggaggtgaaggggctcacgaagggcgggcccggccacgaggagccgatccccatgtccacctacgggtggaacctggtccgcctgcagagcggcgtggacgtgttcttcacgccgcccgagaagtgcgacaccctcctgtgcgacatcggcgagtccagcccgaaccccacgatcgaggccgggcggaccctgcgcgtcctcagcctggtggagaactggctgaacaacgacacccagttctgcatcaaggtgctcaacccctacatgccgtccgtcatcgagaagatggagaccctgcagcggaagtacggcggggccctggtgcgcaaccccctgagccggaactccacccacgagatgtactgggtgagcaacgccacgggcaacatcgtctccagcgtgaacatgatctcccgcatgctcatcaaccggttcaccatgaagcacaagaaggccacctacgagcccgacgtggacctggggagcggcacccgcaacatcggcatcgagtccgagatccccaacctggacatcatcgggaagcgcatcgagaagatcaagcaggagcacgagacgagctggcactacgaccaggaccacccgtacaagacctgggcgtaccacggctcctacgagaccaagcagaccgggagcgcctccagcatggtcaacggcgtggtgcggctcctgacgaagccctgggacgtcgtgcccatggtgacccagatggccatgaccgacaccacgcccttcggccagcagcgcgtcttcaaggagaaggtggacacccggacccaggagccgaaggaggggaccaagaagctgatgaagatcacggccgagtggctctggaaggagctgggcaagaagaagacgccccggatgtgcacccgggaggagttcacccgcaaggtgcggtccaacgccgcgctgggggccatcttcacggacgagaacaagtggaagtccgcccgcgaggccgtcgaggactcccggttctgggagctcgtggacaaggagcgcaacctgcacctggagggcaagtgcgagacctgcgtgtacaacatgatggggaagcgggagaagaagctcggcgagttcggcaaggcgaaggggagccgcgccatctggtacatgtggctgggcgcccggttcctggagttcgaggccctcgggttcctgaacgaggaccactggttctcccgcgagaacagcctgagcggcgtcgagggggagggcctccacaagctgggctacatcctgcgggacgtgtccaagaaggagggcggggccatgtacgcggacgacaccgccgggtgggacacccgcatcacgctcgaggacctgaagaacgaggagatggtcaccaaccacatggagggcgagcacaagaagctggccgaggccatcttcaagctcacctaccagaacaaggtggtgcgggtccagcgccccacgccccgggggacggtgatggacatcatcagccgccgggaccagcgcggctccggccaggtggggacctacggcctgaacaccttcaccaacatggaggcccagctgatccgccagatggagggggagggcgtcttcaagagcatccagcggctcacggtgaccgaggagatcgcggtgcagaactggctggcccgcgtcggccgggagcgcctgtcccggatggccatcagcggggacgactgcgtggtgaagccgctcgacgaccgcttcgcctccgccctgaccgcgctgaacgacatgggcaaggtccggaaggacatccagcagtgggagcccagccgcgggtggaacgactggacccaggtgcccttctgctcccaccacttccacgagctcatcatgaaggacggccgggtgctggtcgtgccctgccgcaaccaggacgagctgatcgggcgggcccgcatcagccagggcgccggctggtccctcaaggagacggcctgcctgggcaagagctacgcccagatgtggtccctgatgtacttccaccggcgcgacctccggctggcggccaacgccatctgcagcgccgtgccgtcccactgggtccccaccagccgcaccacctggtccatccacgcgaagcacgagtggatgaccacggaggacatgctgaccgtgtggaaccgggtgtggatccaggagaacccctggatggaggacaagacccccgtcgagagctgggaggaggtgccgtacctcggcaagcgcgaggaccagtggtgcgggagcctgatcggcctgacctcccgggccacgtgggccaagaacatccagaccgccatcaaccaggtgcgcagcctcatcgggaacgaggagtacaccgactacatgccctccatgaagcgcttccggcgcgaggaggaggaggccggcgtcctgtggtga

SEQ ID NO: 9598 - RNA, 9876 nt, synthetic construct
  misc_feature 1..9876: note = derived and/or modified CDS sequence (opt1) from DENV-2__EU482784__SS-prME
  source 1..9876: mol_type = other RNA
agcgcggggatgatcatcatgctgatccccaccgtgatggccttccacctcaccacccggaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgtgttctgcgactccaagctgatgagcgccgccatcaaggactcccgcgccgtgcacgcggacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccggccggggtaccacacccagaccgccggcccctggcacctcgggcgcctggagatggacttcgacttctgcgagggcaccacggtcgtggtgaccgaggactgcgggaaccggggccccagcctgcgcaccaccacggcgtccggcaagctcatcaccgagtggtgctgccggagctgcaccctgcccccgctgcgctaccgcggggaggacggctgctggtacgggatggagatccgccccctcaaggagaaggaggagaacctggtcaactccctggtgaccgccggccacgggcagatcgacaacttcagcctcggcgtgctgggcatggccctgttcctcgaggagatgctgcggacgcgcatcgggaccaagcacgccatcctgctcgtcgcggtgtccttcgtgaccctgatcaccggcaacatgagcttccgggacctggggcgcgtcatggtgatggtgggcgccacgatgaccgacgacatcgggatgggcgtcacctacctcgccctgctggccgccttcaaggtgcgccccaccttcgcggccggcctcctgctgcggaagctcacgtccaaggagctgatgatgaccaccatcgggatcgtgctgctcagccagtccaccatccccgagacggtcctggagctgaccgacgccctcgccctgggcatgatggtgctgaagatcgtgcgcaacatggagaagtaccagctcgccgtcaccatcatggcgatcctgtgcgtgccgaacgccgtcatcctgcagaacgcctggaaggtgagctgcaccatcctcgccgtggtctccgtgagccccctgctgctcacgtccagccagcagaagaccgactggatccccctggccctgaccatcaaggggctcaaccccaccgcgatcttcctgacgaccctgtcccggaccaacaagaagcgcagctggccgctcaacgaggccatcatggccgtgggcatggtctccatcctggccagctccctgctcaagaacgacatccccatgaccggccccctggtggccggcgggctgctcacggtgtgctacgtcctgaccgggcggagcgccgacctggagctcgagcgcgccaccgacgtgaagtgggaggaccaggccgagatcagcgggtccagccccatcctgtccatcaccatcagcgaggacgggtccatgagcatcaagaacgaggaggaggagcagacgctgaccatcctcatccggaccggcctgctggtgatctccggcctcttcccgatcagcatccccatcaccgccgcggcctggtacctgtgggaggtcaagaagcagcgcgccggggtgctgtgggacgtgcccagcccgccgcccatgggcaaggccgagctcgaggacggggcctaccggatcaagcagaagggcatcctggggtacagccagatcggcgcgggcgtctacaaggaggggaccttccacacgatgtggcacgtgacccgcggcgccgtgctgatgcacaaggggaagcggatcgagccctcctgggccgacgtcaagaaggacctcatcagctacggcgggggctggaagctggagggcgagtggaaggagggggaggaggtccaggtgctggccctcgagcccggcaagaacccccgcgccgtccagaccaagcccgggctgttcaagaccaacacgggcaccatcggggcggtgtccctggacttcagccccggcacctccggcagccccatcatcgacaagaaggggaaggtggtcggcctctacgggaacggcgtggtgacccggtccggcgcctacgtcagcgccatcgcccagacggagaagtccatcgaggacaaccccgagatcgaggacgacatcttccgcaagcggcgcctgaccatcatggacctgcaccccggggccggcaagaccaagcggtacctgcccgcgatcgtgcgcgaggccatcaagcgggggctccgcaccctgatcctggccccgacgcgggtggtcgccgcggagatggaggaggccctccgcggcctgcccatccgctaccagacccccgccatccgggccgagcacaccgggcgcgagatcgtggacctgatgtgccacgccaccttcacgatgcggctcctgagccccgtgcgcgtcccgaactacaacctgatcatcatggacgaggcgcacttcaccgaccccgccagcatcgccgcccggggctacatctccacccgcgtggagatgggcgaggccgcggggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagaccgtctggttcgtgccgagcatcaaggccgggaacgacatcgccgcgtgcctccgcaagaacggcaagaaggtgatccagctgtcccggaagaccttcgacagcgagtacgtcaagacgcgcaccaacgactgggacttcgtggtgaccaccgacatctccgagatgggcgccaacttcaaggccgagcgggtcatcgacccccgccggtgcatgaagcccgtgatcctgacggacggggaggagcgcgtgatcctcgccggccccatgccggtcacccacagctccgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgcgagaaggtggacgccatcgacggcgagtaccggctgcgcggggaggcgcggaagaccttcgtggacctgatgcgccggggcgacctccccgtctggctggcctacaaggtggccgccgaggggatcaactacgccgaccgccggtggtgcttcgacggcatcaagaacaaccagatcctggaggagaacgtggaggtcgagatctggacgaaggagggggagcgcaagaagctcaagccgcggtggctggacgcgcgcatctactccgaccccctggccctcaaggagttcaaggagttcgccgccggccggaagtccctgaccctgaacctcatcaccgagatgggccgcctgcccaccttcatgacgcagaagacccgggacgccctggacaacctcgcggtgctgcacaccgccgaggccgggggccgcgcctacaaccacgcgctgtccgagctccccgagaccctggagacgctgctcctgctgaccctcctggccaccgtcaccgggggcatcttcctgttcctcatgagcggccgggggatcggcaagatgaccctggggatgtgctgcatcatcacggcctccatcctgctctggtacgcccagatccagccgcactggatcgccgcgagcatcatcctggagttcttcctgatcgtgctcctgatccccgagcccgagaagcagcgcacgccccaggacaaccagctgacctacgtggtcatcgccatcctcaccgtggtggccgccacgatggccaacgagatgggcttcctggagaagaccaagaaggacctggggctcggctccatcgcgacccagcagccggagagcaacatcctggacatcgacctgcggcccgccagcgcctggaccctctacgccgtcgccacgaccttcgtgacccccatgctgcgccactccatcgagaacagctccgtgaacgtcagcctgaccgcgatcgccaaccaggccacggtgctcatgggcctggggaagggctggcccctgtccaagatggacatcggggtgccgctcctggccatcggctgctacagccaggtcaaccccatcaccctgaccgccgcgctcctgctgctcgtggcccactacgccatcatcgggcccggcctgcaggccaaggcgacccgggaggcccagaagcgcgccgccgccggcatcatgaagaaccccacggtggacgggatcaccgtcatcgacctggacccgatcccctacgaccccaagttcgagaagcagctcggccaggtgatgctgctgatcctctgcgtgacccaggtcctgatgatgcggaccacgtgggcgctgtgcgaggccctcaccctggccaccgggcccatctccaccctgtgggagggcaacccggggcgcttctggaacacgaccatcgccgtgagcatggccaacatcttccgcggctcctacctcgcgggcgccgggctgctgttcagcatcatgaagaacaccaccaacacgcggcgcggcaccgggaacatcggcgagaccctcggcgagaagtggaagtcccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacatggtgacccccgagggcaaggtcgtggacctgggctgcgggcggggcgggtggagctactactgcggcgggctcaagaacgtgcgcgaggtcaagggcctgaccaagggcgggcccggccacgaggagcccatcccgatgtccacctacgggtggaacctggtgcggctccagagcggcgtggacgtcttcttcatcccgcccgagaagtgcgacacgctgctgtgcgacatcggggagtccagccccaacccgaccgtggaggccggccgcaccctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctctcccgcaacagcacccacgagatgtactgggtgtccaacgcgagcggcaacatcgtgtccagcgtcaacatgatctcccggatgctgatcaaccgcttcacgatgcggcacaagaaggccacctacgagcccgacgtggacctggggagcggcacccgcaacatcgggatcgagtccgagatccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtgaacggcgtcgtgcggctgctgaccaagccgtgggacgtgctccccacggtcacccagatggccatgaccgacaccacgcccttcgggcagcagcgcgtgttcaaggagaaggtggacacccggacccaggagcccaaggagggcaccaagaagctgatgaagatcacggcggagtggctgtggaaggagctcggcaagaagaagaccccgcgcatgtgcacccgggaggagttcacccgcaaggtccggtccaacgccgccctgggggccatcttcacggacgagaacaagtggaagtccgcccgcgaggcggtggaggactcccggttctgggagctggtggacaaggagcgcaacctccacctggagggcaagtgcgagacctgcgtctacaacatgatggggaagcgggagaagaagctgggcgagttcgggaaggccaagggcagccgcgccatctggtacatgtggctcggcgcccggttcctggagttcgaggccctggggttcctcaacgaggaccactggttctcccgcgagaacagcctgagcggcgtggagggggagggcctgcacaagctcgggtacatcctgcgggacgtctccaagaaggagggcggcgcgatgtacgccgacgacaccgccgggtgggacacccgcatcacgctggaggacctcaagaacgaggagatggtgaccaaccacatggagggcgagcacaagaagctggccgaggcgatcttcaagctgacctaccagaacaaggtggtccgggtgcagcgccccacgccccgggggacggtgatggacatcatcagccgccgggaccagcgcggctccgggcaggtcggcacctacggcctcaacaccttcaccaacatggaggcccagctgatccgccagatggagggggagggcgtgttcaagaacatccagcacctgacggtgaccgaggaggtcgccgtgcacaactggctcgcccgggtggggcgcgagcggctgagccgcatggccatctccggcgacgactgcgtcgtgaagcccctggacgaccggttcgcgaacgccctcaccgccctgaacgacatgggcaagatccgcaaggacatccagcagtgggagccgagcaaggggtggaacgactggacccaggtgcccttctgctcccaccacttccacgagctgatcatgaaggacggccgggtcctcgtggtgccctgccgcaaccaggacgagctgatcgggcgggcccgcatcagccagggcgccgggtggtccctgcgggagacggcgtgcctcggcaagagctacgcccagatgtggtccctgatgtacttccaccgccgggacctgcgcctcgccgccaacgccatctgcagcgcggtcccctcccactgggtgccgaccagccggaccacctggtccatccacgccaagcacgagtggatgaccacggaggacatgctgaccgtgtggaaccgcgtctggatccgggagaacccctggatggaggacaagacccccgtggagagctgggaggagatcccctacctgggcaagcgcgaggaccagtggtgcgggtccctcatcggcctgaccagccgggccacgtgggccaagaacatccaggccgcgatcaaccaggtgcgcagcctgatcgggaacgaggagtacaccgactacatgccgtccatgaagcgcttccggcgcgaggaggaggaggccggcgtcctctggtga

SEQ ID NO: 9599 - RNA, 9876 nt, synthetic construct
  misc_feature 1..9876: note = derived and/or modified CDS sequence (opt1) from DENV-2__EU482785__SS-prME
  source 1..9876: mol_type = other RNA
accgccggggtgatcatcatgctgatccccaccgccatggcgttccacctcaccacccggaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgcgctgctggccgccttcaaggtgcgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggagaaggccgagctggaggacggggcctaccggatcaagcagaagggcatcctcgggtacagccagatcggcgccggcgtgtacaaggaggggaccttccacaccatgtggcacgtcacgcgcggcgccgtgctgatgcaccgggggaagcgcatcgagccgtcctgggcggacgtgaagaaggacctgatcagctacggcgggggctggaagctcgagggcgagtggaaggagggggaggaggtccaggtgctggccctggagcccggcaagaacccccgggccgtgcagaccaagcccggcctcttcaagaccaacaccggcacgatcggggccgtctccctggacttcagcccgggcacctccggcagccccatcgtggaccgcaaggggaaggtggtcggcctgtacgggaacggcgtggtgacccggtccggcgcgtacgtcagcgccatcgcccagaccgagaagtccatcgaggacaaccccgagatcgaggacgacatcttccgcaagaagcggctcacgatcatggacctgcaccccggggccggcaagaccaagcgctacctgccggccatcgtgcgggaggcgatcaagcgcgggctgcggaccctcatcctggcccccacccgcgtggtcgccgccgagatggaggaggccctgcgcggcctccccatccggtaccagacgcccgcgatccgcgccgagcacaccgggcgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggcgaggccgccgggatcttcatgaccgcgacgccgcccggcagccgcgaccccttcccccagtccaacgcccccatcatggacgaggagcgggagatccccgagcgcagctggaactccgggcacgagtgggtgacggacttcaagggcaagaccgtctggttcgtgcccagcatcaaggccgggaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggcgcgaacttcaaggccgagcgcgtcatcgacccccggcgctgcatgaagcccgtgatcctgaccgacggggaggagcgggtgatcctggccggcccgatgcccgtcacgcacagctccgccgcccagcgccgggggcgcatcggccgcaaccccaagaacgagaacgaccagtacatctacatgggggagcccctcgagaacgacgaggactgcgcgcactggaaggaggccaagatgctgctggacaacatcaacaccccggagggcatcatccccagcatgttcgagcccgagcgggagaaggtggacgccatcgacggcgagtaccgcctccgcggggaggcccgcaagaccttcgtggacctgatgcggcgcggcgacctgccggtctggctcgcctaccgggtggcggccgaggggatcaactacgccgaccgccggtggtgcttcgacggcgtgaagaacaaccagatcctggaggagaacgtcgaggtggagatctggaccaaggagggggagcgcaagaagctgaagccccggtggctcgacgcccgcatctactccgaccccctggcgctgaaggagttcaaggagttcgccgccggccgcaagagcctcacgctgaacctgatcaccgagatgggccgcctccccaccttcatgacccagaaggcccgggacgccctggacaacctggcggtgctccacacggccgaggccgggggccgcgcctacaaccacgccctgtccgagctgccggagaccctcgagaccctgctgctcctgaccctgctcgcgacggtcaccgggggcatcttcctgttcctgatgagcggcaagggggtgggcaagatgaccctcgggatgtgctgcatcatcaccgcctccatcctgctgtggtacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatgggcttcctcgagaagaccaagaaggacctggggctgggctccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatgggcctcgggaagggctggccgctgtccaagatggacatcggggtgcccctgctcgccatcggctgctacagccaggtgaaccccatcaccctgacggccgcgctgctcctgctggtcgcccactacgccatcatcgggcccggcctccaggccaaggccacccgcgaggcgcagaagcgggccgccgccggcatcatgaagaacccgaccgtggacggggtgaccgtcatcgacctggaccccatcccctacgaccccaagttcgagaagcagctgggccaggtgatgctcctgatcctgtgcgtgacgcaggtcctcatgatgcgcaccacctgggccctgtgcgaggcgctgaccctcgccacggggccgatctccaccctgtgggagggcaaccccgggcgcttctggaacaccaccatcgccgtgagcatggccaacatcttccggggctcctacctggcgggcgccgggctcctgttcagcatcatgaagaacacgaccaacacccgccggggcaccgggaacatcggcgagacgctgggcgagaagtggaagtcccgcctcaacgccctgggcaagagcgagttccagatctacaagaagtccggcatccaggaggtggaccggaccctggccaaggaggggatcaagcgcggcgagaccgaccaccacgccgtcagccgggggtccgcgaagctccgctggttcgtggagcggaacatggtgacccccgagggcaaggtcgtggacctgggctgcgggcgcggcgggtggagctactactgcggcgggctgaaggacgtgcgggaggtcaagggcctcacgaagggcgggcccggccacgaggagccgatccccatgtccacctacgggtggaacctggtgcgcctgcagagcggcgtggacgtcttcttcacgccgcccgagaagtgcgacaccctcctgtgcgacatcggggagtccagcccgaaccccacgatcgaggccggccggaccctgcgcgtgctcagcctggtggagaactggctgaacaacgacacccagttctgcatcaaggtcctcaacccctacatgccgtccgtgatcgagaagatggagaccctgcagcggaagtacggcggggccctggtgcgcaaccccctgagccggaactccacccacgagatgtactgggtcagcaacgccacgggcaacatcgtgtccagcgtgaacatgatctcccgcatgctcatcaaccggttcaccatgaagcacaagaaggccacctacgagcccgacgtcgacctggggagcggcacccgcaacatcgggatcgagtccgagatccccaacctggacatcatcggcaagcgcatcgagaagatcaagcaggagcacgagacgagctggcactacgaccaggaccacccgtacaagacctgggcgtaccacggctcctacgagaccaagcagaccgggagcgcctccagcatggtgaacggcgtggtccggctcctgacgaagccctgggacgtggtgcccatggtcacccagatggccatgaccgacaccacgcccttcgggcagcagcgcgtgttcaaggagaaggtggacacccggacccaggagccgaaggagggcaccaagaagctgatgaagatcacggccgagtggctctggaaggagctgggcaagaagaagacgccccggatgtgcacccgggaggagttcacccgcaaggtccggtccaacgccgcgctgggggccatcttcacggacgagaacaagtggaagtccgcccgcgaggccgtggaggactcccggttctgggagctcgtggacaaggagcgcaacctgcacctggagggcaagtgcgagacctgcgtctacaacatgatggggaagcgggagaagaagctcggcgagttcgggaaggcgaagggcagccgcgccatctggtacatgtggctgggcgcccggttcctggagttcgaggccctcgggttcctgaacgaggaccactggttctcccgcgagaacagcctgagcggcgtggagggggagggcctccacaagctggggtacatcctgcgggacgtctccaagaaggagggcggcgccatgtacgcggacgacaccgccgggtgggacacccgcatcacgctcgaggacctgaagaacgaggagatggtgaccaaccacatggagggcgagcacaagaagctggccgaggccatcttcaagctcacctaccagaacaaggtggtccgggtgcagcgccccacgccccgggggacggtgatggacatcatcagccgccgggaccagcgcggctccgggcaggtcggcacctacggcctgaacaccttcaccaacatggaggcccagctgatccgccagatggagggggagggcgtgttcaagagcatccagcggctcacggtgaccgaggagatcgcggtccagaactggctggcccgcgtggggcgggagcgcctgtcccggatggccatcagcggcgacgactgcgtggtcaagccgctcgacgaccgcttcgcctccgccctgaccgcgctgaacgacatgggcaaggtgcggaaggacatccagcagtgggagcccagccgcgggtggaacgactggacccaggtgcccttctgctcccaccacttccacgagctcatcatgaaggacggccgggtcctggtggtgccctgccgcaaccaggacgagctgatcgggcgggcccgcatcagccagggcgccgggtggtccctcaaggagacggcctgcctgggcaagagctacgcccagatgtggtccctgatgtacttccaccggcgcgacctccggctggcggccaacgccatctgcagcgccgtcccgtcccactgggtgcccaccagccgcaccacctggtccatccacgcgaagcacgagtggatgaccacggaggacatgctgaccgtgtggaaccgggtctggatccaggagaacccctggatggaggacaagacccccgtggagagctgggaggaggtgccgtacctcggcaagcgcgaggaccagtggtgcgggagcctgatcggcctgacctcccgggccacgtgggccaagaacatccagaccgccatcaaccaggtccgcagcctcatcgggaacgaggagtacaccgactacatgccctccatgaagcgcttccggcgcgaggaggaggaggccggcgtgctgtggtga

SEQ ID NO: 9600 - RNA, 9876 nt, synthetic construct
  misc_feature 1..9876: note = derived and/or modified CDS sequence (opt1) from DENV-2__EU482786__SS-prME
  source 1..9876: mol_type = other RNA
agcgccggcatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcgggctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggggaaggactcccccgtcaacatcgaggccgagccgcccttcggcgacagctacatcatcatcggggtggagccgggccagctgaagctcaactggttcaagaaggggtccagcatcggccagatgttcgagaccaccatgcgcggcgcgaagcgcatggccatcctgggggacaccgcctgggacttcggctccctcggcggggtgttcacgagcatcgggaaggccctccaccaggtcttcggggccatctacggcgcggccttctccggggtgagctggaccatgaagatcctgatcggcgtgatcatcacctggatcgggatgaactcccggagcacctccctgagcgtctccctggtgctcgtgggcatcgtcacgctgtacctgggggtgatggtgcaggccgacagcggctgcgtcgtgtcctggaagaacaaggagctcaagtgcggcagcgggatcttcatcaccgacaacgtgcacacctggaccgagcagtacaagttccagcccgagagcccctccaagctggccagcgcgatccagaaggcccaggaggagggcatctgcgggatccgctccgtcacgcggctggagaacctcatgtggaagcagatcacccccgagctgaaccacatcctggccgagaacgaggtgaagctcaccatcatgaccggcgacatcaaggggatcatgcaggccggcaagcgcagcctgcggccgcagcccacggagctgaagtactcctggaagacctggggcaaggccaagatgctcagcaccgagtcctacaaccagaccttcctgatcgacgggcccgagacggcggagtgcccgaacaccaaccgcgcctggaacagcctggaggtggaggactacggcttcggggtcttcaccaccaacatctggctcaagctgaaggagaagcaggacgccttctgcgactccaagctgatgagcgccgccatcaaggacaaccgggcggtgcacgccgacatgggctactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccgggcccgtgagccagcacaactaccgcccgggctaccacacccagatcgcggggccctggcacctgggcaagctggagatggacttcgacttctgcgacgggaccaccgtgatcgtcacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtgaactccctcgtgaccgccgggcacggccaggtcgacaacttcagcctgggcgtgctggggatggccctcttcctggaggagatgctgcggacccgcgtgggcacgaagcacgcgatcctcctggtcgccgtgtccttcgtgaccctgatcaccgggaacatgagcttcaaggacctcggccgggtcgtggtgatggtcggggccaccatggccgacgacatcggcatgggcgtgacgtacctggccctgctcgcggccttcaaggtgcgccccaccttcgccgccgggctgctgctccggaagctgacctccaaggagctgatgatgaccacgatcggcatcgtcctcctgagccagtccaccatccccgagaccgtgctggagctcaccgacgccctggcgctggggatgatggtgctcaagatcgtccgcaacatggagaagtaccagctggccgtgacgatcatggccatcctgtgcgtcccgaacgccgtggtgctccagaacgcctggaaggtcagctgcaccatcctggcggtggtgtccgtcagccccctgctcctgacctccagccagcagaagaccgactggatccccctggccctcacgatcaagggcctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccgggcccctggtcgccggcgggctcctgaccgtgtgctacgtgctgaccggccgcagcgccgacctcgagctggagcgggccacggacgtcaagtgggaggaccaggcggagatctccgggagcagccccatcctgtccatcaccatcagcgaggacggctccatgagcatcaagaacgaggaggaggagcagaccctcaccatcctgatccgcacgggcctgctcgtgatctccgggctgttcccgatcagcatccccatcaccgccgccgcctggtacctgtgggaggtgaagaagcagcgggccggcgtcctctgggacgtgcccagcccgccgcccatggggaaggcggagctggaggacggcgcctaccgcatcaagcagaaggggatcctgggctacagccagatcggcgccggggtgtacaaggagggcaccttccacaccatgtggcacgtcacccgcggggcggtgctcatgcacaagggcaagcgcatcgagccctcctgggccgacgtgaagaaggacctgatcagctacgggggcggctggaagctggagggggagtggaaggagggcgaggaggtccaggtgctcgcgctggagcccgggaagaacccccgggccgtgcagacgaagcccggcctgttcaagaccaacaccgggaccatcggcgccgtctccctcgacttcagccccggcacgtccgggagccccatcatcgacaagaagggcaaggtggtggggctgtacggcaacggcgtcgtgacccgctccggggcctacgtgagcgccatcgcgcagaccgagaagtccatcgaggacaaccccgagatcgaggacgacatcttccggaagcgccggctgaccatcatggacctgcaccccggcgccgggaagacgaagcgctacctccccgccatcgtccgggaggccatcaagcgcggcctgcggaccctgatcctcgcgccgacccgcgtggtggccgccgagatggaggaggccctgcgggggctgcccatccgctaccagacccccgccatcaaggcggagcacacgggccgggagatcgtcgacctcatgtgccacgccaccttcaccatgcgcctgctgagccccgtgcgcgtgccgaactacaacctcatcatcatggacgaggcccacttcaccgaccccgcctccatcgccgcgcggggctacatcagcacgcgcgtcgagatgggggaggccgccggcatcttcatgaccgccacgccgcccgggagccgggacccgttcccccagtccaacgcccccatcatcgacgaggagcgcgagatccccgagcggagctggaactccggccacgagtgggtgaccgacttcaaggggaagacggtgtggttcgtcccgagcatcaaggcgggcaacgacatcgccgcctgcctgcgcaagaacggcaagaaggtgatccagctgtcccggaagaccttcgacagcgagtacgtgaagacccgcaccaacgactgggacttcgtcgtgacgaccgacatctccgagatgggggccaacttcaaggcggagcgggtgatcgacccccgccggtgcatgaagcccgtcatcctcaccgacggcgaggagcgcgtgatcctggccgggcccatgccggtgacccacagctccgccgcccagcggcgcggccggatcgggcgcaaccccaagaacgagaacgaccagtacatctacatgggcgagcccctggagaacgacggcgactgcgcccactggaaggaggcgaagatgctcctggacaacatcaacacgcccgaggggatcatcccgagcatgttcgagcccgagcgggagaaggtcgacgccatcgacggcgagtaccgcctgcgcggggaggcccgcaagaccttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcggggcggaagtccctgaccctcaacctgatcacggagatgggccgcctgcccaccttcatgacccagaagacccgggacgccctcgacaacctggccgtgctgcacacggccgaggccggcgggcgcgcctacaaccacgccctctccgagctgcccgagaccctggagaccctcctgctgctcaccctgctggccacggtgaccggcgggatcttcctcttcctgatgagcgggcgggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatgggcttcctggagaagaccaagaaggacctcggcctggggtccatcgccacgcagcagccggagagcaacatcctggacatcgacctccggcccgcctccgcctggaccctgtacgcggtggccaccaccttcgtcacgcccatgctgcgccacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcggccccgggctgcaggccaaggccacccgggaggcccagaagcgcgccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggaccacctgggccctctgcgaggccctgaccctggccacggggcccatctccaccctctgggagggcaacccgggccgcttctggaacaccaccatcgcggtcagcatggccaacatcttccgggggtcctacctggccggcgccgggctcctgttcagcatcatgaagaacacgaccaacacccgccggggcaccggcaacatcggggagacgctgggcgagaagtggaagtcccgcctgaacgccctcggcaagagcgagttccagatctacaagaagtccggcatccaggaggtggaccgcaccctggcgaaggaggggatcaagcggggcgagaccgaccaccacgccgtgagccgcggctccgccaagctgcggtggttcgtcgagcgcaacatggtgacccccgaggggaaggtggtcgacctcggctgcgggcggggcgggtggagctactactgcggcggcctgaagaacgtgcgcgaggtgaaggggctgacgaagggcgggcccggccacgaggagcccatcccgatgtccacctacgggtggaacctcgtccggctgcagagcggcgtggacgtgttcttcatcccgcccgagaagtgcgacaccctgctctgcgacatcggcgagtccagccccaacccgaccgtcgaggccgggcgcacgctgcgggtgctgaacctcgtggagaactggctgaacaacaacacccagttctgcatcaaggtcctgaacccctacatgccctccgtgatcgagaagatggaggcgctgcagcgcaagtacggcggggccctcgtgcggaacccgctgagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctcgggagcggcacgcgcaacatcggcatcgagtccgagatccccaacctggacatcatcgggaagcggatcgagaagatcaagcaggagcacgagaccagctggcactacgaccaggaccacccctacaagacctgggcctaccacggctcctacgagaccaagcagacggggagcgcgtccagcatggtgaacggcgtggtccgcctgctcaccaagccgtgggacgtgctgcccaccgtgacccagatggccatgacggacaccacccccttcggccagcagcgggtcttcaaggagaaggtggacacccgcacgcaggagcccaaggaggggaccaagaagctgatgaagatcaccgccaagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtcgaggactcccggttctgggagctcgtggacaaggagcgcaacctgcacctggagggcaagtgcgagacctgcgtctacaacatgatggggaagcgggagaagaagctcggcgagttcggcaaggccaaggggagccgcgccatctggtacatgtggctgggcgcgcggttcctggagttcgaggccctcgggttcctgaacgaggaccactggttctcccgcgagaacagcctgtccggcgtggagggggagggcctccacaagctgggctacatcctgcgggacgtgagcaagaaggagggcggggccatgtacgccgacgacacggcggggtgggacacccgcatcaccctcgaggacctgaagaacgaggagatggtcaccaaccacatggagggcgagcacaagaagctggccgaggccatcttcaagctcacgtaccagaacaaggtggtgcgggtccagcgccccacgccccgggggaccgtgatggacatcatcagccgccgggaccagcgcggctccggccaggtggggacctacggcctgaacacgttcaccaacatggaggcccagctgatccggcagatggagggggagggcgtcttcaagaacatccagcacctcaccgtgaccgaggaggtggccgtccagaactggctggcgcgcgtgggccgggagcgcctgagccgcatggccatctccggggacgactgcgtggtcaagcccctcgacgaccggttcgccaacgccctgacggccctgaacgacatgggcaagatccgcaaggacatccagcagtgggagccgagcaaggggtggaacgactggacccaggtgcccttctgctcccaccacttccacgagctcatcatgaaggacggccgggtgctggtcgtgccctgccgcaaccaggacgagctgatcgggcgggcgcgcatcagccagggcgccggctggtccctccgggagaccgcctgcctgggcaagagctacgcccagatgtggtccctgatgtacttccaccgccgggacctccgcctggccgcgaacgccatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacaccgactacatgccgagcatgaagcggttccgccgggaggaggaggaggccggcgtgctgtggtga

SEQ ID NO: 9601 - RNA, 9876 nt, synthetic construct
  misc_feature 1..9876: note = derived and/or modified CDS sequence (opt1) from DENV-2__EU482787__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatcagcaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgcgctgctggccgccttcaaggtgcgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagacctccaccgggacgatcggcgccgtcagcctggacttctccccgggcaccagcgggtcccccatcgtggaccgcaagggcaaggtggtcgggctgtacggcaacggcgtggtgacccggagcggggcgtacgtctccgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgcctccatcgcggcccgcggctacatcagcacccgggtggagatgggggaggccgccggcatcttcatgaccgcgacgccgcccgggtcccgcgaccccttcccccagagcaacgcccccatcatggacgaggagcgggagatccccgagcgctcctggaacagcggccacgagtgggtgacggacttcaaggggaagaccgtctggttcgtgccctccatcaaggccggcaacgacatcgccgcctgcctgcggaagaacggcaagaaggtgatccagctcagccgcaagaccttcgactccgagtacgtcaagacccggacgaacgactgggacttcgtggtgaccaccgacatcagcgagatgggggcgaacttcaaggccgagcgcgtcatcgacccccggcgctgcatgaagcccgtgatcctgaccgacggcgaggagcgggtgatcctggccgggccgatgcccgtcacgcactccagcgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatcccctccatgttcgagcccgagcgggagaaggtggacgccatcgacggggagtaccgcctccggggcgaggcccgcaagaccttcgtggacctgatgcggcgcggggacctgccggtctggctcgcctaccgggtggcggccgagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcccgcatctacagcgaccccctggcgctgaaggagttcaaggagttcgccgccggccggaagtccctcacgctgaacctgatcaccgagatggggcgcctccccaccttcatgacccagaaggcccgggacgccctggacaacctggcggtgctccacacggccgaggccggcgggcgcgcctacaaccacgccctgagcgagctgccggagaccctcgagaccctgctgctcctgaccctgctcgcgacggtcaccggcggcatcttcctgttcctgatgtccgggaagggcgtggggaagatgaccctcggcatgtgctgcatcatcaccgccagcatcctgctgtggtacgcccagatccagccccactggatcgccgcctccatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatggggttcctcgagaagaccaagaaggacctgggcctgggcagcatcgccacgcaggagcccgagagcaacatcctcgacatcgacctgcgccccgcgtccgcctggaccctgtacgccgtggccaccaccttcgtcacgcccatgctccggcacagcatcgagaactccagcgtgaacgtgtccctgaccgcgatcgccaaccaggccaccgtcctgatggggctcggcaaggggtggccgctgagcaagatggacatcggcgtgcccctgctcgccatcgggtgctactcccaggtgaaccccatcaccctgacggccgcgctgctcctgctggtcgcccactacgccatcatcggccccggcctccaggccaaggccacccgcgaggcgcagaagcgggccgccgccgggatcatgaagaacccgaccgtggacggcgtgaccgtcatcgacctggaccccatcccctacgaccccaagttcgagaagcagctgggccaggtgatgctcctgatcctgtgcgtgacgcaggtcctcatgatgcgcaccacctgggccctgtgcgaggcgctgaccctcgccacgggcccgatcagcaccctgtgggaggggaaccccggccgcttctggaacaccaccatcgccgtgtccatggccaacatcttccggggcagctacctggcgggggccggcctcctgttctccatcatgaagaacacgaccaacacccgccgggggaccggcaacatcggcgagacgctgggggagaagtggaagtcccgcctcaacgccctgggcaagtccgagttccagatctacaagaagtccgggatccaggaggtggaccggaccctggccaaggagggcatcaagcgcggggagaccgaccaccacgccgtctcccggggcagcgcgaagctccgctggttcgtggagcggaacatggtgacccccgagggcaaggtcgtggacctggggtgcggccgcgggggctggtcctactactgcgggggcctgaaggacgtgcgggaggtcaagggcctcacgaagggcgggcccgggcacgaggagccgatccccatgagcacctacggctggaacctggtgcgcctgcagtccggggtggacgtcttcttcacgccgcccgagaagtgcgacaccctcctgtgcgacatcggcgagagcagcccgaaccccacgatcgaggccggccggaccctgcgcgtgctctccctggtggagaactggctgaacaacgacacccagttctgcatcaaggtcctcaacccctacatgccgagcgtgatcgagaagatggagaccctgcagcggaagtacgggggcgccctggtgcgcaaccccctgtcccggaacagcacccacgagatgtactgggtctccaacgccacggggaacatcgtgagctccgtgaacatgatcagccgcatgctcatcaaccggttcaccatgaagcacaagaaggccacctacgagcccgacgtcgacctgggctccgggacccgcaacatcggcatcgagagcgagatccccaacctggacatcatcggcaagcgcatcgagaagatcaagcaggagcacgagacgtcctggcactacgaccaggaccacccgtacaagacctgggcgtaccacgggagctacgagaccaagcagaccggctccgccagctccatggtgaacggggtggtccggctcctgacgaagccctgggacgtggtgcccatggtcacccagatggccatgaccgacaccacgcccttcggccagcagcgcgtgttcaaggagaaggtggacacccggacccaggagccgaaggagggcaccaagaagctgatgaagatcacggccgagtggctctggaaggagctggggaagaagaagacgccccgcatgtgcacccgggaggagttcacccgcaaggtccggagcaacgccgcgctgggcgccatcttcacggacgagaacaagtggaagtccgcccgcgaggccgtggaggacagccggttctgggagctcgtggacaaggagcgcaacctgcacctggaggggaagtgcgagacctgcgtctacaacatgatgggcaagcgggagaagaagctcggggagttcggcaaggcgaagggctcccgcgccatctggtacatgtggctgggggcccggttcctggagttcgaggccctcggcttcctgaacgaggaccactggttcagccgcgagaacagcctgtccggggtggagggcgaggggctccacaagctgggctacatcctgcgggacgtcagcaagaaggagggcggggccatgtacgcggacgacaccgccggctgggacacccgcatcacgctcgaggacctgaagaacgaggagatggtgaccaaccacatggagggggagcacaagaagctggccgaggccatcttcaagctcacctaccagaacaaggtggtccgggtgcagcgccccacgccccggggcacggtgatggacatcatctcccgccgggaccagcgcgggagcggccaggtcggcacctacgggctgaacaccttcaccaacatggaggcccagctgatccgccagatggagggcgagggggtgttcaagtccatccagcggctcacggtgaccgaggagatcgcggtccagaactggctggcccgcgtgggccgggagcgcctgagccggatggccatctccggcgacgactgcgtggtcaagccgctcgacgaccgcttcgccagcgccctgaccgcgctgaacgacatggggaaggtgcggaaggacatccagcagtgggagccctcccgcggctggaacgactggacccaggtgcccttctgcagccaccacttccacgagctcatcatgaaggacgggcgggtcctggtggtgccctgccgcaaccaggacgagctgatcggccgggcccgcatctcccagggggccggctggagcctcaaggagacggcctgcctgggcaagtcctacgcccagatgtggagcctgatgtacttccaccggcgcgacctccggctggcggccaacgccatctgctccgccgtcccgagccactgggtgcccacctcccgcaccacctggagcatccacgcgaagcacgagtggatgaccacggaggacatgctgaccgtgtggaaccgggtctggatccaggagaacccctggatggaggacaagacccccgtggagagctgggaggaggtgccgtacctcgggaagcgcgaggaccagtggtgcggctccctgatcgggctgaccagccgggccacgtgggccaagaacatccagaccgccatcaaccaggtccgctccctcatcggcaacgaggagtacaccgactacatgcccagcatgaagcgcttccggcgcgaggaggaggaggccggggtgctgtggtga

SEQ ID NO: 9602 - RNA, 9876 nt, synthetic construct
  misc_feature 1..9876: note = derived and/or modified CDS sequence (opt1) from DENV-2__EU482788__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgcgctgctggccgccttcaaggtgcgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggggcgaacttcaaggccgagcgcgtcatcgacccccggcgctgcatgaagcccgtgatcctgaccgacggcgaggagcgggtgatcctggccgggccgatgcccgtcacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgggagaaggtggacgccatcgacggggagtaccgcctccggggcgaggcccgcaagaccttcgtggacctgatgcggcgcggggacctgccggtctggctcgcctaccgggtggcggccgagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcccgcatctactccgaccccctggcgctgaaggagttcaaggagttcgccgccggccgcaagagcctcacgctgaacctgatcaccgagatggggcgcctccccaccttcatgacccagaaggcccggaacgccctggacaacctggcggtgctccacacggccgaggccggcgggcgcgcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggtacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgcgaggcgcagaagcgggccgccgccgggatcatgaagaacccgaccgtggacggcatcaccgtgatcgacctggaccccatcccctacgaccccaagttcgagaagcagctggggcaggtcatgctcctgatcctgtgcgtgacccaggtgctcatgatgcgcaccacctgggccctgtgcgaggcgctgaccctcgccacgggcccgatctccaccctgtgggaggggaaccccggccgcttctggaacaccaccatcgccgtcagcatggccaacatcttccggggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtgagccggggctccgcgaagctccgctggttcgtcgagcggaacatggtgacccccgagggcaaggtggtcgacctggggtgcggccgcgggggctggagctactactgcgggggcctgaaggacgtgcgggaggtgaagggcctcacgaagggcggccccgggcacgaggagccgatccccatgtccacctacggctggaacctggtccgcctgcagagcggggtggacgtgttcttcacgccgcccgagaagtgcgacaccctcctgtgcgacatcggcgagtccagcccgaaccccacgatcgaggccggccggaccctgcgcgtcctcagcctggtggagaactggctgaacaacgacacccagttctgcatcaaggtgctcaacccctacatgccgtccgtcatcgagaagatggagaccctgcagcggaagtacgggggcgccctggtgcgcaaccccctgagccggaactccacccacgagatgtactgggtgagcaacgccacggggaacatcgtctccagcgtgaacatgatctcccgcatgctcatcaaccggttcaccatgaagcacaagaaggccacctacgagcccgacgtggacctgggcagcgggacccgcaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtcaacggggtggtgcggctcctgacgaagccctgggacgtcgtgcccatggtgacccagatggccatgaccgacaccacgcccttcggccagcagcgcgtcttcaaggagaaggtggacacccggacccaggagccgaaggagggcaccaagaagctgatgaagatcacggccgagtggctctggaaggagctggggaagaagaagacgccccggatgtgcacccgggaggagttcacccgcaaggtgcggtccaacgccgcgctgggcgccatcttcacggacgagaacaagtggaagtccgcccgcgaggccgtcgaggactcccggttctgggagctcgtggacaaggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtcgagggcgaggggctccacaagctgggctacatcctgcgggacgtgtccaagaaggagggcggggccatgtacgcggacgacaccgccggctgggacacccgcatcacgctcgaggacctgaagaacgaggagatggtcaccaaccacatggagggggagcacaagaagctggccgaggccatcttcaagctcacctaccagaacaaggtggtgcgggtccagcgccccacgccccggggcacggtgatggacatcatcagccgccgggaccagcgcgggtccggccaggtgggcacctacgggctgaacaccttcaccaacatggaggcccagctgatccgccagatggagggcgagggggtcttcaagagcatccagcggctcacggtgaccgaggagatcgcggtgcagaactggctggcccgcgtcggccgggagcgcctgtcccggatggccatcagcggcgacgactgcgtggtgaagccgctcgacgaccgcttcgcctccgccctgaccgcgctgaacgacatggggaaggtccggaaggacatccagcagtgggagcccagccgcggctggaacgactggacccaggtgcccttctgctcccaccacttccacgagctcatcatgaaggacgggcgggtgctggtcgtgccctgccgcaaccaggacgagctgatcggccgggcccgcatcagccagggggccggctggtccctcaaggagacggcctgcctgggcaagagctacgcccagatgtggtccctgatgtacttccaccggcgcgacctccggctggcggccaacgccatctgcagcgccgtgccgtcccactgggtccccaccagccgcaccacctggtccatccacgcgaagcacgagtggatgaccacggaggacatgctgaccgtgtggaaccgggtgtggatccaggagaacccctggatggaggacaagacccccgtcgagagctgggaggaggtgccgtacctcgggaagcgcgaggaccagtggtgcggcagcctgatcgggctgacctcccgggccacgtgggccaagaacatccagaccgccatcaaccaggtgcgcagcctcatcggcaacgaggagtacaccgactacatgccctccatgaagcgcttccggcgcgaggaggaggaggccggggtcctgtggtga

SEQ ID NO: 9603 - RNA, 9876 nt, synthetic construct
  misc_feature 1..9876: note = derived and/or modified CDS sequence (opt1) from DENV-2__EU482697__SS-prME
  source 1..9876: mol_type = other RNA
agcgccgggatgatcatcatgctgatccccaccgtgatggccttccacctcaccacccggaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatgacggacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtaccgggaggggaccttccacaccatgtggcacgtgacgcgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccggtccggcgcctacgtgagcgccatcgcccagaccgagaagtccatcgaggacaaccccgagatcgaggacgacatcttccgcaagcggcgcctgacgatcatggacctgcaccccggggcgggcaagaccaagcggtacctccccgccatcgtgcgcgaggccatcaagcgggggctgcgcaccctgatcctcgccccgacccgggtcgtggcggccgagatggaggaggccctgcgcggcctgcccatccggtaccagacgcccgccatccgcgccgagcacaccgggcgcgagatcgtggacctcatgtgccacgcgaccttcaccatgcggctgctgagccccgtccgcgtgccgaactacaacctcatcatcatggacgaggcccacttcacggaccccgcctccatcgccgcccggggctacatcagcacccgcgtggagatgggcgaggcggccgggatcttcatgaccgccacgccgcccggcagccgggacccgttcccccagtccaacgcccccatcatcgacgaggagcgcgagatccccgagcggagctggaactccgggcacgagtgggtcacggacttcaagggcaagaccgtgtggttcgtgccgagcatcaaggccgggaacgacatcgcggcctgcctgcgcaagaacggcaagaaggtcatccagctgtcccggaagaccttcgacagcgagtacgtgaagacccgcacgaacgactgggacttcgtggtcaccaccgacatctccgagatgggcgccaacttcaaggccgagcgggtgatcgacccccgccggtgcatgaagcccgtgatcctcaccgacggggaggagcgcgtcatcctggcgggccccatgccggtgacgcacagctccgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgcgatcgacggcgagtaccgcctgcgcggggaggcccggaagaccttcgtcgacctcatgcgccggggcgacctgcccgtgtggctggcctacaaggtggccgccgaggggatcaactacgcggaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgccggccggaagtccctgacgctcaacctgatcaccgagatgggccgcctgcccaccttcatgacccagaagacgcgggacgcgctcgacaacctggccgtcctgcacaccgccgaggccgggggccgcgcgtacaaccacgccctctccgagctgcccgagaccctggagaccctcctgctgctcacgctgctggccaccgtgaccgggggcatcttcctcttcctgatgagcggccgggggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgaccgtggtcgccgccaccatggcgaacgagatgggcttcctggagaagacgaagaaggacctcgggctgggctccatcgccacccagcagccggagagcaacatcctggacatcgacctccggcccgcctccgcctggaccctgtacgccgtggcgaccacgttcgtgacccccatgctgcgccacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcacgctcaccgcggccctgctgctcctggtggcccactacgccatcatcgggcccggcctgcaggcgaaggccacccgggaggcccagaagcgcgccgccgcgggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcggaccacctgggccctctgcgaggccctgacgctggccaccgggcccatctccaccctctgggagggcaacccggggcgcttctggaacaccacgatcgccgtgagcatggcgaacatcttccggggctcctacctggccggcgccgggctcctcttcagcatcatgaagaacaccaccaacacccgccgcggcacggggaacatgggcgagaccctgggcgagaagtggaagtcccggctgaacgccctcggcaagagcgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacgcccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgacggtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctcgggagcggcacccgcaacatcgggaccgagtccgagatccccaacctggacatcatcggcaagcggatcgagaagatcaagcaggagcacgagaccagctggcactacgaccaggaccacccctacaagacgtgggcctaccacggctcctacgagaccaagcagaccgggagcgcctccagcatggtcaacggcgtggtgcgcctgctcaccaagccgtgggacgtcctgcccatggtgacgcagatggcgatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggccatcttcaccgacgagaacaagtggaagtccgcgcgcgaggccgtggaggactcccggttctgggagctcgtcgacaaggagcgcaacttccacctggagggcaagtgcgagacgtgcgtgtacaacatgatggggaagcgggagaagaagctgggcgagttcgggaaggccaagggcagccgcgccatctggtacatgtggctcggcgcccggttcctggagttcgaggcgctggggttcctcaacgaggaccactggttctcccgcgagaacagcctgtccggcgtcgagggggagggcctgcacaagctcgggtacatcctgcgggacgtgagcaagaaggagggcggcgccatgtacgccgacgacaccgccgggtgggacacccgcatcaccctggaggacctcaagaacgaggagatggtgacgaaccacatggagggcgagcacaagaagctggcggaggccatcttcaagctgacctaccagaacaaggtcgtgcgggtgcagcgccccacgccccgggggaccgtcatggacatcatcagccgccgggaccagcgcggctccggccaggtggggacgtacggcctcaacaccttcaccaacatggaggcccagctgatccggcagatggagggggagggcgtgttcaagaacatccagcacctgaccgtcacggaggaggtggccgtgaagaactggctcgcccgcgtcgggcgcgagcggctgagccgcatggcgatctccggcgacgactgcgtggtgaagcccctggacgaccggttcgccaacgccctcaccgccctgaacgacatgggcaagatccgcaaggacatccagcagtgggagccgagcaaggggtggaacgactggacccaggtccccttctgctcccaccacttccacgagctgatcatgaaggacggccgggtgctcgtggtcccctgccgcaaccaggacgagctgatcgggcgggcccgcatcagccagggcgcggggtggtccctgcgggagaccgcctgcctcggcaagagctacgcccagatgtggtccctgatgtacttccaccgccgggacctgcgcctcgccgccaacgcgatctgcagcgccgtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctgggcaagcgcgaggaccagtggtgcgggtccctcatcggcctgaccagccgggccacctgggccaagaacatccaggcggccatcaaccaggtccgctccctgatcgggaacgaggagtacacggactacatgccgagcatgaagcggttccgccgcgaggaggaggaggccggcgtgctctggtga

SEQ ID NO: 9604 - RNA, 9876 nt, synthetic construct
  misc_feature 1..9876: note = derived and/or modified CDS sequence (opt1) from DENV-2__EU482699__SS-prME
  source 1..9876: mol_type = other RNA
agcgccggcatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcggatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtggaggactacgggttcggcgtcttcaccaccaacatctggctccggctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcatcctgggcatggccctcttcctggaggagatgctgcgcacccgggtggggacgaagcacgcgatcctcctggccgccgtgtccttcgtcaccctgatcaccggcaacatgagcttcaaggacctcgggcgcgtgatggtgatggtcggcgccaccatggccgacgacatcgggatgggcgtgacgtacctggcgctgctcgccgccttcaaggtgcggcccaccttcgccgccggcctgctgctccgccgcctgacctccaaggagctgatgatgaccacgatcgggatcgtcctcctgagccagtccaccatccccgagaccgtgctggagctcaccgacgcgctggccctgggcatgatggtgctcaagatcgtccggaagatggagaagtaccagctggccgtgacgatcatggccatcctgtgcgtgccgaacgccgtcatcctccagaacgcgtggaaggtgagctgcaccatcctggccgtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggcgatcatggccgtcggcatggtgtccatcctggccagctccctcctgaagaacgacatccccatgaccggccccctggtggccgggggcctcctgaccgtctgctacgtgctgaccgggcgcagcgccgacctcgagctggagcgggcgacggacgtgaagtgggaggaccaggccgagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggcgggggtgctctgggacgtccccagcccgccgcccgtgggcaaggccgagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggcggacgtgaagaaggacctgatcagctacggcgggggctggaagctggagggcgagtggaaggagggggaggaggtccaggtgctcgccctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgcgatcgcccagaccgagaagtccatcgaggacaaccccgagatcgaggacgacatcttccggaagcgccggctgaccatcatggacctgcaccccggggccggcaagacgaagcgctacctccccgccatcgtccgggaggcgatcaagcgcgggctgcggaccctgatcctcgccccgacccgcgtggtggccgccgagatggaggaggccctgcggggcctgcccatccgctaccagacccccgcgatccgcgccgagcacacggggcgggagatcgtcgacctcatgtgccacgccaccttcaccatgcgcctgctgagccccgtgcgggtgccgaactacaacctcatcatcatggacgaggcccacttcaccgaccccgcctccatcgcggcccgcggctacatcagcacgcgggtcgagatgggcgaggccgccgggatcttcatgaccgccacgccgcccggcagccgcgacccgttcccccagtccaacgcgcccatcatcgacgaggagcgggagatccccgagcgcagctggaactccgggcacgagtgggtgaccgacttcaagggcaagacggtgtggttcgtcccgagcatcaaggccgggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgcgaacttcaaggccgagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacgcccgagggcatcatcccgagcatgttcgagcccgagcgcgagaaggtcgacgccatcgacggcgagtaccgcctgcgcggggaggcccgcaagaccttcgtggacctcatgcggcgcggcgacctgcccgtgtggctggcctacaaggtcgcggccgaggggatcaactacgccgaccggcgctggtgcttcgacggcatcaagaacaaccagatcctcgaggagaacgtggaggtggagatctggaccaagggcggggagaagaagaagctgaagccgcggtggctggacgcccgcatctactccgaccccctcgccctgaaggagttcaaggagttcgcggccggccggaagtccctgaccctcaacctgatcacggagatggggcgcctgcccaccttcatgacccagaagacccgggacgccctcgacaacctggccgtcctgcacacggcggaggccggcgggcgcgcctacaaccacgccctctccgagctgcccgagaccctggagaccctcctgctgctcaccctgctggccacggtgaccggcggcatcttcctcttcctgatgagcgggcggggcatcgggaagatgaccctgggcatgtgctgcatcatcaccgcgtccatcctcctgtggtacgcccagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggcggccaccatggccaacgagatggggttcctggagaagaccaagaaggacctcggcctgggctccatcgccacgcagcagccggagagcaacatcctggacatcgacctccggcccgcctccgcgtggaccctgtacgccgtggccaccaccttcgtcacgcccatgctgcgccacagcatcgagaacagctccgtgaacgtgagcctcaccgccatcgccaaccaggcgaccgtcctgatggggctgggcaaggggtggcccctctccaagatggacatcggcgtgccgctgctggccatcgggtgctacagccaggtgaaccccatcaccctcacggccgccctgctgctcctggtcgcgcactacgccatcatcggccccggcctgcaggccaaggccacccgggaggcccagaagcgcgcggccgccgggatcatgaagaaccccaccgtggacggcatcaccgtgatcgacctcgacccgatcccctacgaccccaagttcgagaagcagctggggcaggtcatgctgctcatcctgtgcgtgacccaggtgctgatgatgcggaccacctgggccctctgcgaggccctgaccctggcgacgggccccatctccaccctctgggaggggaacccgggccgcttctggaacaccaccatcgccgtcagcatggccaacatcttccggggctcctacctggccggggccggcctcctcttcagcatcatgaagaacacgaccaacacccgccgcgggaccggcaacatgggcgagacgctgggggagaagtggaagtcccggctgaacgcgctcggcaagagcgagttccagatctacaagaagtccgggatccaggaggtggaccgcaccctggccaaggagggcatcaagcgcggggagaccgaccaccacgccgtgagccgcggctccgccaagctgcggtggttcgtcgagcgcaacatggtgacccccgagggcaaggtggtcgacctcgggtgcggccgcggcgggtggagctactactgcgggggcctgaagaacgtgcgcgaggtgaagggcctgacgaagggcgggcccgggcacgaggagcccatcccgatgtccacctacggctggaacctcgtccggctgcagagcggggtggacgtgttcttcatcccgcccgagaagtgcgacaccctgctctgcgacatcggcgagtccagccccaacccgaccgtcgaggcgggccgcacgctgcgggtgctgaacctcgtggagaactggctgaacaacaacacccagttctgcatcaaggtcctgaacccctacatgccctccgtgatcgagaagatggaggccctgcagcgcaagtacgggggcgccctcgtgcggaacccgctgagccgcaacagcacccacgagatgtactgggtctccaacgccagcgggaacatcgtgtccagcgtgaacatgatctcccggatgctgatcaaccgcttcaccatgcggcacaagaaggccacctacgagcccgacgtcgacctcggcagcgggacgcgcaacatcggcatcgagtccgagatccccaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtgaacggggtggtccgcctgctcaccaagccgtgggacgtgctgcccaccgtgacccagatggccatgacggacaccacccccttcggccagcagcgcgtcttcaaggagaaggtggacacccggacgcaggagcccaaggagggcaccaagaagctgatgaagatcaccgccgagtggctctggaaggagctggggaagaagaagaccccgcgcatgtgcacgcgggaggagttcacccgcaaggtgcggtccaacgccgcgctgggcgccatcttcaccgacgagaacaagtggaagtccgcccgcgaggccgtcgaggactcccggttctgggagctcgtggacaaggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttctcccgcgagaacagcctgtccggggtcgagggcgaggggctccacaagctgggctacatcctgcgggacgtgagcaagaaggagggcggggccatgtacgcggacgacacggccggctgggacacccgcatcaccctcgaggacctgaagaacgaggagatggtcaccaaccacatggagggggagcacaagaagctggccgaggccatcttcaagctcacgtaccagaacaaggtggtgcgggtccagcgccccacgccccggggcaccgtgatggacatcatcagccgccgggaccagcgcgggtccggccaggtgggcacctacgggctgaacacgttcaccaacatggaggcccagctgatccggcagatggagggcgagggggtcttcaagaacatccagcacctcaccgtgaccgaggaggtggcggtccagaactggctggcccgcgtgggccgcgagcggctgagccgcatggccatctccggcgacgactgcgtggtcaagcccctcgacgaccggttcgccaacgccctgacggcgctgaacgacatggggaagatccgcaaggacatccagcagtgggagccgagcaagggctggaacgactggacccaggtgcccttctgctcccaccacttccacgagctcatcatgaaggacgggcgggtgctggtcgtgccctgccgcaaccaggacgagctgatcggccgggcccgcatcagccagggggccggctggtccctccgggagaccgcctgcctgggcaagagctacgcccagatgtggtccctgatgtacttccaccgccgggacctccgcctggcggccaacgccatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcgggaagcgcgaggaccagtggtgcggctccctgatcgggctgaccagccgggcgacctgggccaagaacatccaggccgccatcaaccaggtgcgctccctcatcggcaacgaggagtacaccgactacatgccgagcatgaagcggttccgccgcgaggaggaggaggcgggggtgctgtggtga

SEQ ID NO: 9605 - RNA, 9876 nt, synthetic construct
  misc_feature 1..9876: note = derived and/or modified CDS sequence (opt1) from DENV-2__EU482701__SS-prME
  source 1..9876: mol_type = other RNA
agcgcggggatgatcatcatgctgatccccaccgtgatggccttccacctcaccacccggaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgaagcagaacgagcccgaggacatcgactgctggtgcaacagcacctccacctgggtgacctacgggacctgcaccaccaccggcgagcaccggcgcgagaagcggagcgtggccctggtgccccacgtggggatgggcctcgagacgcgcaccgagacctggatgtccagcgagggggcctggaagcacgcccagcggatcgagacctggatcctgcgccacccgggcttcacgatcatggccgcgatcctggcctacaccatcgggaccacccacttccagcgggtcctcatcttcatcctgctgacggccgtggccccctccatgaccatgcgctgcatcggcatcagcaaccgggacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccgcaagtactgcatcgaggccaagctgaccaacacgaccaccgagagccggtgccccacccagggcgagccctccctgaaggaggagcaggacaagcgcttcgtgtgcaagcacagcatggtggaccggggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccgcaccggcctcgacttcaacgagatggtgctgctgcagatggagaacaaggcctggctcgtgcaccggcagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacgccgccctgacgggcgccaccgagatccagatgagctccgggaacctcctgttcaccggccacctgaagtgccgcctgcggatggacaagctccagctgaagggcatgagctactccatgtgcaccgggaagttcaaggtggtcaaggagatcgccgagacgcagcacggcaccatcgtgatccgcgtgcagtacgagggggacggcagcccctgcaagatccccttcgagatcatggacctggagaagcggtacgtcctcggccgcctgatcaccgtgaacccgatcgtgaccgagaaggactcccccgtcaacatcgaggcggagccgcccttcggggacagctacatcatcatcggcgtggagccggggcagctgaagctcaactggttcaagaagggctccagcatcgggcagatgttcgagacgaccatgcggggcgccaagcgcatggccatcctgggcgacaccgcctgggacttcgggtccctgggcggggtgttcaccagcatcggcaaggccctccaccaggtcttcggggcgatctacggcgccgccttctccggcgtgagctggacgatgaagatcctgatcggggtgatcatcacctggatcggcatgaactcccgcagcacctccctgagcgtctccctggtgctcgtggggatcgtcaccctgtacctgggcgtgatggtgcaggccgacagcgggtgcgtcgtgtcctggaagaacaaggagctcaagtgcggcagcggcatcttcatcacggacaacgtgcacacctggaccgagcagtacaagttccagcccgagagcccctccaagctggcgagcgccatccagaaggcccaggaggaggggatctgcggcatccggtccgtcacccgcctggagaacctcatgtggaagcagatcacgcccgagctgaaccacatcctggccgagaacgaggtgaagctcaccatcatgaccggggacatcaagggcatcatgcaggccgggaagcggagcctgcgcccgcagcccaccgagctgaagtactcctggaagacgtggggcaaggcgaagatgctcagcaccgagtcccacaaccagaccttcctgatcgacggccccgagaccgccgagtgcccgaacacgaaccgggcctggaacagcctggaggtggaggactacgggttcggcgtcttcaccaccaacatctggctccgcctgaaggagaagcaggacgccttctgcgactccaagctgatgagcgccgcggtgaaggacaaccgggccgtgcacgccgacatggggtactggatcgagtccgccctcaacgacacctggaagatcgagaaggccagcttcatcgaggtcaagaactgccactggcccaagtcccacacgctgtggagcaacggcgtgctggagtccgagatggtgatccccaagaacctcgcgggccccgtcagccagcacaactaccgcccggggtaccacacccagatcgccggcccctggcacctggggaagctggagatggacttcgacttctgcgacggcaccaccgtgatcgtgaccgaggactgcgggaaccggggcccctccctccgcacgaccaccgccagcggcaagctgatcaccgagtggtgctgccggagctgcacgctgcccccgctccgctaccgcggggaggacggctgctggtacgggatggagatccgccccctgaaggagaaggaggagaacctggtcaactccctcgtgaccgccggccacggccaggtggacaacttcagcctgggcatcctgggcatggccctcttcctggaggagatgctgcggacccgcgtcgggaccaagcacgccatcctcctggtggccgtgtccttcgtcacgctgatcaccggcaacatgagcttcaaggacctcgggcgggtggtggtcatggtgggcgccaccatggccgacgacatcgggatgggcgtgacctacctggcgctgctcgccgccttcaaggtccgccccacgttcgccgccggcctgctgctccggaagctgacctccaaggagctgatgatgaccaccatcggggtggtgctcctgagccagtccacgatccccgacaccgtcctggagctcaccgacgcgctggccctgggcatgatggtgctcaagatcgtccgcaacatggagaagtaccagctggccgtgaccatcatggccatcctgtgcgtgccgaacgccgtcatcctccagaacgcgtggaaggtgagctgcacgatcctggccgtggtctccgtgagccccctgctcctgacctccagccagcagaagaccgactggatccccctggccctcaccatcaaggggctgaaccccacggccatcttcctgaccaccctctcccgcaccaacaagaagcggagctggccgctgaacgaggcgatcatggccgtgggcatggtctccatcctggccagctccctcctgaagaacgacatccccatgacgggccccctggtggccgggggcctcctgaccgtgtgctacgtcctgaccgggcgcagcgccgacctcgagctggagcgggcgaccgacgtgaagtgggaggaccaggccgagatctccggcagcagccccatcctgtccatcacgatcagcgaggacgggtccatgagcatcaagaacgaggaggaggagcagaccctcaccatcctgatccgcaccggcctgctcgtgatctccggcctgttcccgatcagcatccccatcacggccgccgcctggtacctgtgggaggtcaagaagcagcgggcgggggtgctctgggacgtgcccagcccgccgcccatgggcaaggccgagctggaggacggggcctaccgcatcaagcagaagggcatcctggggtacagccagatcggcgccggcgtctacaaggaggggaccttccacaccatgtggcacgtgacccggggcgccgtgctcatgcacaaggggaagcgcatcgagccctcctgggcggacgtcaagaaggacctgatcagctacggcgggggctggaagctggagggcgagtggaaggagggggaggaggtccaggtgctcgccctggagcccggcaagaacccccgggccgtccagaccaagcccgggctgttcaagacgaacaccggcaccatcggggccgtgtccctcgacttcagccccggcacctccggcagccccatcatcgacaagaaggggaaggtggtcggcctgtacgggaacggcgtggtgacgcgctccggcgcctacgtcagcgcgatcgcccagaccgagaagtccatcgaggacaaccccgagatcgaggacgacatcttccggaagcgccggctgaccatcatggacctgcaccccggggccggcaagaccaagcgctacctccccgccatcgtgcgggaggcgatcaagcgcgggctgcggacgctgatcctcgccccgacccgcgtggtcgccgccgagatggaggaggccctgcggggcctgcccatccgctaccagacccccgcgatccgggccgagcacaccgggcgcgagatcgtggacctcatgtgccacgccacgttcaccatgcgcctgctgagccccgtgcgggtcccgaactacaacctcatcatcatggacgaggcccacttcaccgaccccgcctccatcgcggcccgcggctacatcagcacccgggtggagatgggcgaggccgccgggatcttcatgacggccacgccgcccggcagccgcgacccgttcccccagtccaacgcgcccatcatcgacgaggagcgggagatccccgagcgcagctggaactccgggcacgagtgggtgaccgacttcaagggcaagaccgtctggttcgtgccgagcatcaaggccgggaacgacatcgccgcctgcctgcggaagaacggcaagaaggtgatccagctgtcccgcaagacgttcgacagcgagtacgtcaagacccggaccaacgactgggacttcgtggtgaccacggacatctccgagatgggcgcgaacttcaaggccgagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgcgagaaggtggacgccatcgacggcgagtaccggctgcgcggggaggcccgcaagacgttcgtggacctcatgcggcgcggcgacctgcccgtctggctggcctacaaggtggcggccgaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgcggccggccgcaagagcctgaccctcaacctgatcaccgagatgggccggctgcccacgttcatgacccagaagacccgcgacgccctcgacaacctggccgtgctgcacaccgcggaggccgggggccgggcctacaaccacgccctctccgagctgcccgagacgctggagaccctcctgctgctcaccctgctggccaccgtcaccggcgggatcttcctcttcctgatgagcgggcgcgggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcggacgccccaggacaaccagctcacctacgtggtcatcgccatcctgacggtggtggcggccaccatggccaacgagatgggcttcctggagaagaccaagaaggacctcgggctgggctccatcgccacccagcagccggagagcaacatcctggacatcgacctccgccccgcctccgcgtggacgctgtacgccgtcgccaccaccttcgtgacccccatgctgcggcacagcatcgagaacagctccgtgaacgtcagcctcacggccatcgccaaccaggcgaccgtgctgatgggcctggggaagggctggcccctctccaagatggacatcggggtgccgctgctggccatcggctgctacagccaggtcaaccccatcaccctcaccgccgccctgctgctcctggtggcgcactacgccatcatcgggcccggcctgcaggccaaggccacgcgcgaggcccagaagcgggcggccgccggcatcatgaagaaccccaccgtggacgggatcaccgtcatcgacctcgacccgatcccctacgaccccaagttcgagaagcagctgggccaggtgatgctgctcatcctgtgcgtgacccaggtcctgatgatgcgcacgacctgggccctctgcgaggccctgaccctggcgaccgggcccatctccacgctctgggagggcaacccggggcggttctggaacaccaccatcgccgtgagcatggccaacatcttccgcggctcctacctggccggcgccgggctcctcttcagcatcatgaagaacaccacgaacacccggcgcggcaccgggaacatgggcgagaccctgggcgagaagtggaagtcccgcctgaacgcgctcgggaagtccgagttccagatctacaagaagtccggcatccaggaggtggaccggacgctggccaaggaggggatcaagcgcggcgagaccgaccaccacgccgtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgaccaagggcgggcccggccacgaggagcccatcccgatgtccacgtacgggtggaacctcgtgcgcctgcagagcggcgtggacgtcttcttcatcccgcccgagaagtgcgacaccctgctctgcgacatcggggagtccagccccaacccgaccgtggaggcgggccggaccctgcgcgtgctgaacctcgtcgagaactggctgaacaacaacacgcagttctgcatcaaggtgctgaacccctacatgccctccgtgatcgagaagatggaggccctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacccggaacatcgggatcgagtccgagatccccaacctggacatcatcggcaagcgcatcgagaagatcaagcaggagcacgagacgagctggcactacgaccaggaccacccctacaagacctgggcgtaccacggctcctacgagaccaagcagaccgggagcgcctccagcatggtgaacggcgtcgtgcggctgctcacgaagccgtgggacgtgctgcccaccgtcacccagatggccatgaccgacacgacccccttcgggcagcagcgcgtgttcaaggagaaggtggacacccgcacccaggagcccaaggagggcacgaagaagctgatgaagatcaccgccgagtggctctggaaggagctgggcaagaagaagaccccgcggatgtgcacccgcgaggagttcacgcggaaggtccgctccaacgccgcgctgggggccatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggcgatctggtacatgtggctgggcgcccgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgcggacgacaccgccgggtgggacacgcggatcaccctcgaggacctgaagaacgaggagatggtgaccaaccacatggagggcgagcacaagaagctggccgaggccatcttcaagctcacctaccagaacaaggtggtccgcgtgcagcggcccacgccccgcgggaccgtgatggacatcatcagccggcgcgaccagcggggctccgggcaggtcggcacctacggcctgaacaccttcacgaacatggaggcccagctgatccgccagatggagggggagggcgtgttcaagaacatccagcacctcaccgtgaccgaggaggtcgcggtgcagaactggctggcccgggtggggcgcgagcgcctgagccggatggccatctccggcgacgactgcgtcgtgaagcccctcgacgaccgcttcgccaacgccctgaccgcgctgaacgacatgggcaagatccggaaggacatccagcagtgggagccgagcaaggggtggaacgactggacgcaggtccccttctgctcccaccacttccacgagctcatcatgaaggacggccgcgtcctggtggtgccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtcccctcccactgggtgccgaccagccgcaccacgtggtccatccacgccaagcacgagtggatgaccaccgaggacatgctgaccgtgtggaaccgggtctggatccgcgagaacccctggatggaggacaagacccccgtggagagctgggaggagatcccctacctcggcaagcgggaggaccagtggtgcgggtccctgatcggcctgacgagccgcgcgacctgggccaagaacatccaggccgccatcaaccaggtgcggtccctcatcgggaacgaggagtacaccgactacatgccgagcatgaagcgcttccggcgcgaggaggaggaggcgggcgtcctgtggtga

SEQ ID NO: 9606 - RNA, 9876 nt, synthetic construct
  misc_feature 1..9876: note = derived and/or modified CDS sequence (opt1) from DENV-2__EU482703__SS-prME
  source 1..9876: mol_type = other RNA
agcgccgggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgagcagcgagggggcctggaagcacgcccagcggatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtggggtgcaccatcctggcggtcgtgagcgtgagccccctgctcctgaccagctcccagcagaagaccgactggatccccctggccctcacgatcaagggcctgaaccccaccgccatcttcctgaccaccctcagccgcacgaacaagaagcggtcctggccgctgaacgaggccatcatggcggtcggcatggtgagcatcctggcctccagcctcctgaagaacgacatccccatgaccgggcccctggtggccggcgggctcctgaccgtctgctacgtgctgaccggccgctccgccgacctcgagctggagcgggccacggacgtgaagtgggaggaccaggcggagatcagcgggtccagccccatcctgagcatcaccatctccgaggacggcagcatgtccatcaagaacgaggaggaggagcagaccctcaccatcctgatccgcacgggcctgctcgtcatcagcgggctgttcccgatctccatccccatcaccgccgccgcctggtacctgtgggaggtgaagaagcagcgggccggcgtgctctgggacgtcccctccccgccgcccatggggaaggcggagctggaggacggcgcctaccgcatcaagcagaaggggatcctgggctactcccagatcggcgccggggtgtacaaggagggcaccttccacaccatgtggcacgtgacccgcggggccgtcctcatgcacaagggcaagcgcatcgagcccagctgggccgacgtgaagaaggacctgatctcctacgggggcggctggaagctggagggggagtggaaggagggcgaggaggtgcaggtcctcgcgctggagcccgggaagaacccccgggccgtgcagacgaagcccggcctgttcaagaccaacaccgggaccatcggcgccgtgagcctcgacttctcccccggcacgagcgggtcccccatcatcgacaagaagggcaaggtcgtggggctgtacggcaacggcgtggtcacccgcagcggggcctacgtgtccgccatcgcgcagaccgagaagtccatcgaggacaaccccgagatcgaggacgacatcttccggaagcgccggctgaccatcatggacctgcaccccggcgccgggaagacgaagcgctacctccccgccatcgtgcgggaggccatcaagcgcggcctgcggaccctgatcctcgcgccgacccgcgtcgtggccgccgagatggaggaggccctgcgggggctgcccatccgctaccagacccccgccatccgggcggagcacacgggccgcgagatcgtggacctcatgtgccacgccaccttcaccatgcgcctgctgtcccccgtccgggtgccgaactacaacctcatcatcatggacgaggcccacttcaccgaccccgccagcatcgccgcgcgcggctacatctccacgcgggtggagatgggggaggccgccggcatcttcatgaccgccacgccgcccgggagccgcgacccgttcccccagagcaacgcccccatcatcgacgaggagcgggagatccccgagcgctcctggaacagcggccacgagtgggtcaccgacttcaaggggaagacggtgtggttcgtgccgtccatcaaggcgggcaacgacatcgccgcctgcctgcggaagaacggcaagaaggtcatccagctgagccgcaagaccttcgactccgagtacgtgaagacccggaccaacgactgggacttcgtggtcacgaccgacatcagcgagatgggggccaacttcaaggcggagcgcgtgatcgacccccggcgctgcatgaagcccgtgatcctcaccgacggcgaggagcgggtcatcctggccgggcccatgccggtgacccactccagcgccgcccagcgccggggccgcatcgggcggaaccccaagaacgagaacgaccagtacatctacatgggcgagcccctggagaacgacgaggactgcgcccactggaaggaggcgaagatgctcctggacaacatcaacacgcccgagggcatcatcccgtccatgttcgagcccgagcgcgagaaggtggacgccatcgacggggagtaccggctgcgcggcgaggcccgcaagaccttcgtcgacctcatgcggcgcggggacctgcccgtgtggctggcctacaaggtggccgcggagggcatcaactacgccgaccggcgctggtgcttcgacgggatcaagaacaaccagatcctcgaggagaacgtcgaggtggagatctggaccaaggagggcgagcggaagaagctgaagccgcgctggctggacgcccggatctacagcgaccccctcgccctgaaggagttcaaggagttcgccgcgggccgcaagtccctgaccctcaacctgatcacggagatggggcggctgcccaccttcatgacccagaagacccgcgacgccctcgacaacctggccgtcctgcacacggccgaggcgggcgggcgggcctacaaccacgccctcagcgagctgcccgagaccctggagaccctcctgctgctcaccctgctggccacggtgaccggcggcatcttcctcttcctgatgtccgggcgcggcatcgggaagatgaccctgggcatgtgctgcatcatcaccgccagcatcctcctgtggtacgcgcagatccagccgcactggatcgccgcctccatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatggggttcctggagaagaccaagaaggacctcggcctgggcagcatcgccacgcagcagccggagtccaacatcctggacatcgacctccgccccgccagcgcctggaccctgtacgcggtggccaccaccttcgtgacgcccatgctgcggcactccatcgagaacagcagcgtcaacgtgtccctcaccgccatcgccaaccaggccaccgtgctgatggggctgggcaaggggtggcccctcagcaagatggacatcggcgtcccgctgctggcgatcgggtgctactcccaggtgaaccccatcaccctcacggccgccctgctgctcctggtggcccactacgcgatcatcggccccggcctgcaggccaaggccacccgcgaggcccagaagcgggccgcggccgggatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacgggccccatcagcaccctctgggaggggaacccgggccggttctggaacaccaccatcgcggtgtccatggccaacatcttccgcggcagctacctggccggggccggcctcctcttctccatcatgaagaacacgaccaacacccggcgcgggaccggcaacatgggcgagacgctgggggagaagtggaagtcccgcctgaacgccctcggcaagtccgagttccagatctacaagcggagcgggatccaggaggtcgaccgcaccctggcgaaggagggcatcaagcgcggggagaccgaccaccacgccgtgtcccgcggcagcgccaagctgcggtggttcgtggagcgcaacatggtcacccccgagggcaaggtggtggacctcgggtgcggccgcggcgggtggtcctactactgcgggggcctgaagaacgtccgcgaggtgaagggcctgacgaagggcgggcccgggcacgaggagcccatcccgatgagcacctacggctggaacctcgtgcggctgcagtccggggtcgacgtgttcttcatcccgcccgagaagtgcgacaccctgctctgcgacatcggcgagagctcccccaacccgaccgtggaggccggccgcacgctgcgggtcctgaacctcgtggagaactggctgaacaacaacacccagttctgcatcaaggtgctgaacccctacatgcccagcgtcatcgagaagatggaggcgctgcagcgcaagtacgggggcgccctcgtgcggaacccgctgtcccgcaacagcacccacgagatgtactgggtgagcaacgcctccgggaacatcgtcagctccgtgaacatgatcagccggatgctgatcaaccgcttcaccatgcggcacaagaaggccacctacgagcccgacgtggacctcggctccgggacgcgcaacatcggcatcgagagcgagatccccaacctggacatcatcggcaagcggatcgagaagatcaagcaggagcacgagacctcctggcactacgaccaggaccacccctacaagacctgggcctaccacgggagctacgagaccaagcagacgggctccgcgagctccatggtcaacggggtggtgcgcctgctcaccaagccgtgggacgtcctgcccaccgtgacccagatggccatgacggacaccacccccttcggccagcagcgcgtgttcaaggagaaggtcgacacccggacgcaggagcccaaggagggcaccaagaagctgatgaagatcaccgccgagtggctctggaaggagctggggaagaagaagaccccgcgcatgtgcacgcgggaggagttcaccaagaaggtgcgcagcaacgccgccctgggcgcgatcttcaccgacgagaacaagtggaagtccgcccgggaggccgtggaggacagccgcttctgggagctcgtcgacaaggagcggaacctgcacctggaggggaagtgcgagacctgcgtgtacaacatgatgggcaagcgcgagaagaagctcggggagttcggcaaggccaagggctcccgggccatctggtacatgtggctgggggcgcgcttcctggagttcgaggccctcggcttcctgaacgaggaccactggttcagccgggagaactccctgagcggggtcgagggcgaggggctccacaagctgggctacatcctgcgcgacgtgtccaagaaggagggcggggccatgtacgccgacgacacggcgggctgggacacccggatcaccctcgaggacctgaagaacgaggagatggtgaccaaccacatgaagggggagcacaagaagctggccgaggccatcttcaagctcacgtaccagaacaaggtcgtgcgcgtgcagcggcccacgccccggggcaccgtcatggacatcatcagccggcgcgaccagcgggggagcggccaggtgggcacctacgggctgaacacgttcaccaacatggaggcccagctgatccgccagatggagggcgagggggtgttcaagaacatccagcacctcaccgtcaccgaggaggtggccgtgcagaactggctggcgcgggtcggccgcgagcgcctgtcccggatggccatcagcggcgacgactgcgtggtgaagcccctcgacgaccgcttcgccaacgccctgacggccctgaacgacatggggaagatccggaaggacatccagcagtgggagccgtccaagggctggaacgactggacccaggtccccttctgcagccaccacttccacgagctcatcatgaaggacgggcgcgtgctggtggtcccctgccggaaccaggacgagctgatcggccgcgcgcggatctcccagggggccggctggagcctccgcgagaccgcctgcctgggcaagtcctacgcccagatgtggagcctgatgtacttccaccggcgcgacctccggctggccgcgaacgccatctgctccgccgtgcccagccactgggtgccgacctcccgcacgacctggagcatccacgccaagcacgagtggatgaccaccgaggacatgctgaccgtctggaaccgggtgtggatccgcgagaacccctggatggaggacaagacgcccgtggagtcctgggaggagatcccctacctcgggaagcgggaggaccagtggtgcggcagcctgatcgggctgacctcccgcgccacctgggcgaagaacatccaggccgccatcaaccaggtccggagcctcatcggcaacgaggagtacaccgactacatgccgtccatgaagcgcttccggcgcgaggaggaggaggccggggtgctgtggtga

SEQ ID NO: 9607 - RNA, 9876 nt, synthetic construct
  misc_feature 1..9876: note = derived and/or modified CDS sequence (opt1) from DENV-2__EU482705__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcgcggtgtccttcgtgaccctgatcaccggcaacatgagcttcaaggacctcgggcgggtcgtggtgatggtcggcgccacgatggccgacaacatcgggatgggcgtgacctacctggccctgctcgccgcgttcaaggtgcgccccaccttcgccgccggcctgctgctccggcgcctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccggaccaacaagaagcgcagctggccgctgaacgaggccatcatggccgtcggcatggtgtccatcctggcgagctccctcctgaagaacgacatccccatgaccggccccctggtggccgggggcctcctgaccgtctgctacgtgctgacggggcggagcgccgacctcgagctggagcgcgccaccgacgtgaagtgggaggaccaggccgagatctccggcagcagccccatcctgtccatcaccatcagcgaggacgggtccatgagcatcaagaacgaggaggaggagcagaccctcacgatcctgatccggaccggcctgctcgtcatctccggcctgttcccgatcagcatccccatcaccgcggccgcctggtacctgtgggaggtgaagaagcagcgcgccggggtgctctgggacgtccccagcccgccgcccatgggcaaggccgagctggaggacggggcgtaccggatcaagcagaagggcatcctggggtacagccagatcggcgccggcgtgtacaaggaggggaccttccacaccatgtggcacgtgacgcgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccggtccggcgcctacgtgagcgccatcgcccagaccgagaagtccatcgaggacaaccccgagatcgaggacgacatcttccgcaagcggcgcctgacgatcatggacctgcaccccggggcgggcaagaccaagcggtacctccccgccatcgtgcgcgaggccatcaagcgggggctgcgcaccctgatcctcgccccgacccgggtcgtggcggccgagatggaggaggccctgcgcggcctgcccatccggtaccagacgcccgccatccgcgccgagcacaccgggcgcgagatcgtggacctcatgtgccacgcgaccttcaccatgcggctgctgagccccgtccgcgtgccgaactacaacctcatcatcatggacgaggcccacttcacggaccccgcctccatcgccgcccggggctacatcagcacccgcgtggagatgggcgaggcggccgggatcttcatgaccgccacgccgcccggcagccgggacccgttcccccagtccaacgcccccatcatcgacgaggagcgcgagatccccgagcggagctggaactccgggcacgagtgggtcacggacttcaagggcaagaccgtgtggttcgtgccgagcatcaaggccgggaacgacatcgcggcctgcctgcgcaagaacggcaagaaggtcatccagctgtcccggaagaccttcgacagcgagtacgtgaagacccgcacgaacgactgggacttcgtggtcaccaccgacatctccgagatgggcgccaacttcaaggccgagcgggtgatcgacccccgccggtgcatgaagcccgtgatcctcaccgacggggaggagcgcgtcatcctggcgggccccatgccggtgacgcacagctccgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgcgatcgacggcgagtaccgcctgcgcggggaggcccggaagaccttcgtcgacctcatgcgccggggcgacctgcccgtgtggctggcctacaaggtggccgccgaggggatcaactacgcggaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgccggccggaagtccctgacgctcaacctgatcaccgagatgggccgcctgcccaccttcatgacccagaagacgcgggacgcgctcgacaacctggccgtcctgcacaccgccgaggccgggggccgcgcgtacaaccacgccctctccgagctgcccgagaccctggagaccctcctgctgctcacgctgctggccaccgtgaccgggggcatcttcctcttcctgatgagcggccgggggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgaccgtggtcgccgccaccatggcgaacgagatgggcttcctggagaagacgaagaaggacctcgggctgggctccatcgccacccagcagccggagagcaacatcctggacatcgacctccggcccgcctccgcctggaccctgtacgccgtggcgaccacgttcgtgacccccatgctgcgccacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcacgctcaccgcggccctgctgctcctggtggcccactacgccatcatcgggcccggcctgcaggcgaaggccacccgggaggcccagaagcgcgccgccgcgggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcggaccacctgggccctctgcgaggccctgacgctggccaccgggcccatctccaccctctgggagggcaacccggggcgcttctggaacaccacgatcgccgtgagcatggcgaacatcttccggggctcctacctggccggcgccgggctcctcttcagcatcatgaagaacaccaccaacacccgccgcggcacggggaacatcggcgagaccctgggcgagaagtggaagtcccggctgaacgccctcggcaagagcgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacgcccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgacggtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctgctcaccaagccgtgggacgtcctgcccaccgtgacgcagatggcgatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggccatcttcaccgacgagaacaagtggaagtccgcgcgcgaggccgtggaggactcccggttctgggagctcgtcgacaaggagcgcaacctgcacctggagggcaagtgcgagacgtgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgccgggtgggacacccgcatcaccctcgaggacctgaagaacgaggagatggtgacgaaccacatggagggcgagcacaagcggctggcggaggccatcttcaagctcacctaccagaacaaggtcgtgcgcgtgcagcggcccacgccccgggggaccgtcatggacatcatcagccggcgcgaccagcggggctccggccaggtggggacgtacggcctgaacaccttcaccaacatggaggcccagctgatccgccagatggagggggagggcgtgttcaagaacatccagcacctcaccgtcacggaggaggtggccgtgcagaactggctggcccgcgtcgggcgggagcgcctgagccggatggcgatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggccaagaacatccaggcggccatcaaccaggtccggtccctcatcgggaacgaggagtacacggactacatgccgagcatgaagcgcttccgccgggaggaggaggaggccggcgtgctgtggtga

SEQ ID NO: 9608 - RNA, 9876 nt, synthetic construct
  misc_feature 1..9876: note = derived and/or modified CDS sequence (opt1) from DENV-2__EU482463__SS-prME
  source 1..9876: mol_type = other RNA
agcgccggcatgatcatcatgctgatccccaccgtgatggccttccacctcaccacccggaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgctccgtcgccctggtgccccacgtgggcatggggctcgagacccggaccgagacctggatgagctccgagggcgcctggaagcacgcccagcggatcgagacctggatcctgcggcacccggggttcacgatcatggccgcgatcctggcctacaccatcggcaccacccacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggcgaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagcacgcggtggggaacgacacgggcaagcacgggaaggagatcaaggtgaccccgcagtccagcatcaccgaggccgagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacaagcaggagagcaactggatccagaaggagaccctggtcaccttcaagaacccccacgccaagaagcaggacgtggtcgtgctcgggagccaggagggcgcgatgcacacggccctgaccggggccaccgagatccagatgtccagcggcaacctgctgttcaccgggcacctgaagtgccggctgcgcatggacaagctccagctgaagggcatgtcctacagcatgtgcacgggcaagttcaaggtggtcaaggagatcgccgagacccagcacgggaccatcgtgatccgggtgcagtacgagggcgacgggtccccctgcaagatccccttcgagatcatggacctggagaagcgctacgtcctcggccggctgatcaccgtgaacccgatcgtgacggagaaggacagccccgtcaacatcgaggccgagccgcccttcggcgactcctacatcatcatcggggtggagccgggccagctgaagctcaactggttcaagaaggggagctccatcggccagatgttcgagaccaccatgcgcggggcgaagcgcatggccatcctgggcgacaccgcctgggacttcggcagcctcggcggggtgttcacgtccatcgggaaggccctccaccaggtcttcggggccatctacggggcggccttcagcggcgtgtcctggaccatgaagatcctgatcggcgtgatcatcacctggatcgggatgaacagccggtccaccagcctgtccgtcagcctggtgctcgtgggcatcgtcacgctgtacctgggggtgatggtgcaggccgactccggctgcgtcgtgagctggaagaacaaggagctcaagtgcgggagcggcatcttcatcaccgacaacgtgcacacctggaccgagcagtacaagttccagcccgagtcccccagcaagctggcctccgcgatccagaaggcccaggaggagggcatctgcgggatccgcagcgtcacgcggctggagaacctcatgtggaagcagatcacccccgagctgaaccacatcctggccgagaacgaggtgaagctcaccatcatgaccggcgacatccgcgggatcatgcaggccggcaagcggtccctgcgcccgcagcccacggagctgaagtacagctggaagacctgggggaaggccaagatgctctccaccgagagctacaaccagaccttcctgatcgacggccccgagacggcggagtgcccgaacaccaaccgggcctggaactccctggaggtggaggactacggcttcggggtcttcaccaccaacatctggctcaagctgaaggagaagcaggacgccttctgcgacagcaagctgatgtccgccgccatcaaggacaaccgcgcggtgcacgccgacatgggctactggatcgagagcgccctcaacgacacgtggaagatcgagaaggcctccttcatcgaggtgaagaactgccactggcccaagagccacaccctgtggtccaacggggtcctggagagcgagatgatcatccccaagaacctcgccggccccgtgtcccagcacaactaccggccgggctaccacacccagatcgcggggccctggcacctgggcaagctggagatggacttcgacttctgcgacgggaccaccgtgatcgtcacggaggactgcggcaaccgcgggcccagcctccggaccaccaccgccagcggcaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccaggtcgacaacttctccctgggggtgctgggcatggccctcttcctggaggagatgctgcgcacccgggtgggcacgaagcacgcgatcctcctggtcgccgtgagcttcgtgaccctgatcaccgggaacatgtccttcaaggacctcggccgcgtcgtggtgatggtcggggccaccatggccgacgacatcggcatgggggtgacgtacctggccctgctcgcggccttcaaggtgcggcccaccttcgccgccggcctgctgctccgcaagctgaccagcaaggagctgatgatgaccacgatcggcatcgtcctcctgtcccagagcaccatccccgagaccgtgctggagctcaccgacgccctggcgctggggatgatggtgctcaagatcgtccgcaacatggagaagtaccagctggccgtgacgatcatggccatcctgtgcgtcccgaacgccgtgatcctccagaacgcctggaaggtgtcctgcaccatcctggcggtcgtgagcgtgagccccctgctcctgaccagctcccagcagaagaccgactggatccccctggccctcacgatcaagggcctgaaccccaccgccatcttcctgaccaccctcagccggacgaacaagaagcgctcctggccgctgaacgaggccatcatggcggtcgggatggtgagcatcctggcctccagcctcctgaagaacgacatccccatgaccggccccctggtggccggcgggctcctgaccgtctgctacgtgctgaccggccggtccgccgacctcgagctggagcgcgccacggacgtgaagtgggaggaccaggcggagatcagcgggagctcccccatcctgagcatcaccatctccgaggacggcagcatgtccatcaagaacgaggaggaggagcagaccctcaccatcctgatccggacggggctgctcgtcatcagcggcctgttcccgatctccatccccatcaccgccgccgcctggtacctgtgggaggtgaagaagcagcgcgccggcgtgctctgggacgtcccctccccgccgcccatggggaaggcggagctggaggacggcgcctaccggatcaagcagaaggggatcctgggctactcccagatcggggccggcgtgtacaaggagggcaccttccacaccatgtggcacgtgacccgcggggccgtcctcatgcacaagggcaagcggatcgagcccagctgggccgacgtgaagaaggacctgatctcctacgggggcgggtggaagctggagggcgagtggaaggagggcgaggaggtgcaggtcctcgcgctggagcccgggaagaacccccgcgccgtgcagacgaagcccggcctgttcaagaccaacaccgggaccatcggcgccgtgagcctcgacttctcccccgggacgagcggctcccccatcatcgacaagaagggcaaggtcgtggggctgtacggcaacggggtggtcacccggagcggcgcctacgtgtccgccatcgcgcagaccgagaagtccatcgaggacaaccccgagatcgaggacgacatcttccgcaagcggcgcctgaccatcatggacctgcaccccggcgccgggaagacgaagcggtacctccccgccatcgtgcgcgaggccatcaagcggggcctgcgcaccctgatcctcgcgccgacccgggtcgtggccgccgagatggaggaggccctgcgcgggctgcccatccggtaccagacccccgccatccgcgcggagcacacgggccgcgagatcgtggacctcatgtgccacgccaccttcaccatgcggctgctgtcccccgtccgcgtgccgaactacaacctcatcatcatggacgaggcccacttcaccgaccccgccagcatcgccgcgcgggggtacatcagcacgcgcgtggagatgggcgaggccgccggcatcttcatgaccgccacgccgcccgggtcccgggacccgttcccccagagcaacgcccccatcatcgacgaggagcgcgagatccccgagcggtcctggaacagcggccacgagtgggtcaccgacttcaaggggaagacggtgtggttcgtgccgtccatcaaggcgggcaacgacatcgccgcctgcctgcgcaagaacgggaagaaggtcatccagctgagccggaagaccttcgactccgagtacgtgaagacccgcaccaacgactgggacttcgtggtcacgaccgacatcagcgagatgggcgccaacttcaaggcggagcgggtgatcgacccccgccggtgcatgaagcccgtgatcctcaccgacggcgaggagcgcgtcatcctggccgggcccatgccggtgacccactccagcgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacgcccgaggggatcatcccgtccatgttcgagcccgagcgggagaaggtggacgccatcgacggcgagtaccgcctgcgcggcgaggcccggaagaccttcgtcgacctcatgcgccgcggggacctgcccgtgtggctggcctacaaggtggccgcggagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcccgcatctacagcgaccccctcgccctgaaggagttcaaggagttcgccgcggggcggaagtccctgaccctcaacctgatcacggagatgggccgcctgcccaccttcatgacccagaagacccgggacgccctcgacaacctggccgtcctgcacacggccgaggcgggcgggcgcgcctacaaccacgccctcagcgagctgcccgagaccctggagaccctcctgctgctcaccctgctggccacggtgaccggcgggatcttcctcttcctgatgtccggccggggcatcgggaagatgaccctgggcatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatggggttcctggagaagaccaagaaggacctcggcctggggagcatcgccacgcagcagccggagtccaacatcctggacatcgacctccggcccgccagcgcctggaccctgtacgcggtggccaccaccttcgtgacgcccatgctgcgccacagcatcgagaactccagcgtcaacgtgtccctcaccgccatcgccaaccaggccaccgtgctgatgggcctgggcaaggggtggcccctcagcaagatggacatcggcgtcccgctgctggcgatcgggtgctactcccaggtgaaccccatcaccctcacggccgccctgctgctcctggtggcccactacgcgatcatcggccccgggctgcaggccaaggccacccgggaggcccagaagcgcgccgcggccggcatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacgggccccatcagcaccctctgggaggggaacccgggccgcttctggaacaccaccatcgcggtgtccatggccaacatcttccgggggagctacctggccggcgccggcctcctgttctccatcatgaagaacacgaccaacacccgccgcgggaccggcaacatcggggagacgctgggcgagaagtggaagtcccggctgaacgccctcggcaagtccgagttccagatctacaagaagtccgggatccaggaggtcgaccgcaccctggcgaaggagggcatcaagcgcggggagaccgaccaccacgccgtgtcccgcggcagcgccaagctgcggtggttcgtggagcgcaacatggtcacccccgaggggaaggtggtggacctcggctgcggccgcggcgggtggtcctactactgcggcgggctgaagaacgtccgcgaggtgaaggggctgacgaagggcgggcccgggcacgaggagcccatcccgatgagcacctacggctggaacctcgtgcggctgcagtccggggtcgacgtgttcttcatcccgcccgagaagtgcgacaccctgctctgcgacatcggcgagagctcccccaacccgaccgtggaggccgggcgcacgctgcgggtcctgaacctcgtggagaactggctgaacaacaacacccagttctgcatcaaggtgctgaacccctacatgcccagcgtcatcgagaagatggaggcgctgcagcgcaagtacggcggcgccctcgtgcggaacccgctgagccgcaactccacccacgagatgtactgggtgagcaacgcctccgggaacatcgtcagctccgtgaacatgatcagccggatgctgatcaaccgcttcaccatgcggcacaagaaggccacctacgagcccgacgtggacctcggctccgggacgcgcaacatcggcatcgagagcgagaagcccaacctggacatcatcgggaagcggatcgagaagatcaagcaggagcacgagacctcctggcactacgaccaggaccacccctacaagacctgggcctaccacggcagctacgagaccaagcagacgggctccgcgagctccatggtcaacggggtggtgcgcctgctcaccaagccgtgggacgtcctgcccaccgtgacccagatggccatgacggacaccacccccttcggccagcagcgcgtgttcaaggagaaggtcgacacccggacgcaggagcccaaggaggggaccaagaagctgatgaagatcaccgccgagtggctctggaaggagctgggcaagaagaagaccccgcgcatgtgcacgcgggaggagttcacccgcaaggtgcggagcaacgccgccctgggcgcgatcttcaccgacgagaacaagtggaagtccgcccgcgaggccgtggaggacagccggttctgggagctcgtcgacaaggagcgcaacctgcacctggaggggaagtgcgagacctgcgtgtacaacatgatgggcaagcgggagaagaagctcggggagttcggcaaggccaaggggtcccgcgccatctggtacatgtggctgggcgcgcggttcctggagttcgaggccctcggcttcctgaacgaggaccactggttcagccgcgagaactccctgagcggggtcgagggcgaggggctccacaagctgggctacatcctgcgggacgtgagcaagaaggagggcggcgccatgtacgccgacgacacggcgggctgggacacccgcatcaccctcgaggacctgaagaacgaggagatggtgaccaaccacatggagggggagcacaagaagctggccgaggccatcttcaagctcacgtaccagaacaaggtcgtgcgggtgcagcgccccacgccccggggcaccgtcatggacatcatctcccgccgggaccagcgcgggagcggccaggtggggacctacggcctgaacacgttcaccaacatggaggcccagctgatccggcagatggagggcgagggggtgttcaagaacatccagcacctcaccgtcaccgaggaggtggccgtgcacaactggctggcgcgcgtcggccgcgagcggctgtcccgcatggccatcagcggggacgactgcgtggtgaagcccctcgacgaccggttcgccaacgccctgacggccctgaacgacatgggcaagatccgcaaggacatccagcagtgggagccgtccaagggctggaacgactggacccaggtccccttctgcagccaccacttccacgagctcatcatgaaggacgggcgggtgctggtggtcccctgccgcaaccaggacgagctgatcggccgggcgcgcatctcccagggggccggctggagcctccgggagaccgcctgcctggggaagtcctacgcccagatgtggagcctgatgtacttccaccgccgggacctccgcctggccgcgaacgccatctgctccgccgtgcccagccactgggtgccgacctcccggacgacctggagcatccacgccaagcacgagtggatgaccaccgaggacatgctgaccgtctggaaccgcgtgtggatccgggagaacccctggatggaggacaagacgcccgtggagtcctgggaggagatcccctacctcggcaagcgcgaggaccagtggtgcggcagcctgatcgggctgacctcccgggccacctgggcgaagaacatccaggccgccatcaaccaggtccgcagcctcatcggcaacgaggagtacaccgactacatgccgagcatgaagcggttccgccgcgaggaggaggaggccggggtgctgtggtga

SEQ ID NO: 9609 - RNA, 9876 nt, synthetic construct
  misc_feature 1..9876: note = derived and/or modified CDS sequence (opt1) from DENV-2__EU482464__SS-prME
  source 1..9876: mol_type = other RNA
agcgcgggcatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcgcggtgtccttcgtgaccctgatcaccggcaacatgagcttcaaggacctcgggcgggtcgtggtgatggtcggcacgaccatggccgacgacatcgggatgggcgtgacctacctggccctgctcgccgccttcaaggtgcgccccaccttcgcggccggcctgctgctccggaagctgacgtccaaggagctgatgatgaccaccatcgggatcgtcctcctgagccagtccaccatccccgagacggtgctggagctcaccgacgccctggccctgggcatgatggtgctcaagatcgtccgcaacatggagaagtaccagctggccgtgaccatcatggcgatcctgtgcgtcccgaacgccgtgatcctccagaacgcctggaaggtgagctgcaccatcctggccgtcgtgtccgtgagccccctgctcctgacgtccagccagcagaagaccgactggatccccctggccctcaccatcaaggggctgaaccccaccgcgatcttcctgacgaccctctcccgcaccaacaagaagcggagctggccgctgaacgaggccatcatggccgtcggcatggtgtccatcctggccagctccctcctgaagaacgacatccccatgaccggccccctggtggccggcgggctcctgacggtctgctacgtgctgaccgggcgcagcgccgacctcgagctggagcgggccaccgacgtgaagtgggaggaccaggccgagatctccgggagcagccccatcctgtccatcaccatcagcgaggacgggtccatgagcatcaagaacgaggaggaggagcagacgctcaccatcctgatccgcaccggcctgctcgtcatctccggcctgttcccgatcagcatccccatcaccgccgcggcctggtacctgtgggaggtgaagaagcagcgggccggggtgctctgggacgtccccagcccgccgcccatgggcaaggccgagctggaggacggggcctaccgcatcaagcagaagggcatcctggggtacagccagatcggcgcgggcgtgtacaaggaggggaccttccacacgatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggccgtgcagaccaagcccgggctgttcaagaccaacacgggcaccatcggggcggtgtccctcgacttcagccccggcacctccggcagccccatcatcgacaagaaggggaaggtcgtgggcctgtacgggaacggcgtggtcacccgctccggcgcctacgtgagcgccatcgcccagacggagaagtccatcgaggacaaccccgagatcgaggacgacatcttccggaagcgccggctgaccatcatggacctgcaccccggggccggcaagaccaagcgctacctccccgcgatcgtgcgggaggccatcaagcgcgggctgcggaccctgatcctcgccccgacgcgcgtcgtggccgcggagatggaggaggccctgcggggcctgcccatccgctaccagacccccgccatccgggccgagcacaccgggcgcgagatcgtggacctcatgtgccacgccaccttcacgatgcgcctgctgagccccgtccgggtgccgaactacaacctcatcatcatggacgaggcgcacttcaccgaccccgcctccatcgccgcccgcggctacatcagcacccgggtggagatgggcgaggccgcggggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagaccgtgtggttcgtgccgagcatcaaggccgggaacgacatcgccgcgtgcctgcggaagaacggcaagaaggtcatccagctgtcccgcaagaccttcgacagcgagtacgtgaagacgcggaccaacgactgggacttcgtggtcaccaccgacatctccgagatgggcgccaacttcaaggccgagcgcgtgatcgacccccggcgctgcatgaagcccgtgatcctcacggacggggaggagcgggtcatcctggccggccccatgccggtgacccacagctccgcggcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgccatcgacggcgagtaccggctgcgcggggaggcgcgcaagaccttcgtcgacctcatgcggcgcggcgacctgcccgtgtggctggcctacaaggtggccgccgaggggatcaactacgccgaccggcgctggtgcttcgacggcatcaagaacaaccagatcctcgaggagaacgtcgaggtggagatctggacgaaggagggggagcggaagaagctgaagccgcgctggctggacgcgcggatctactccgaccccctcgccctgaaggagttcaaggagttcgccgccggccgcaagagcctgaccctcaacctgatcaccgagatgggccggctgcccaccttcatgacgcagaagacccgcgacgccctcgacaacctggcggtcctgcacaccgccgaggccgggggccgggcctacaaccacgcgctctccgagctgcccgagaccctggagacgctcctgctgctcaccctgctggccaccgtgaccgggggcatcttcctcttcctgatgagcggccgcgggatcggcaagatgaccctggggatgtgctgcatcatcacggcctccatcctcctgtggtacgcccagatccagccgcactggatcgccgcgagcatcatcctggagttcttcctcatcgtgctgctgatccccgagcccgagaagcagcggacgccccaggacaaccagctcacctacgtcgtgatcgccatcctgaccgtggtcgccgccacgatggccaacgagatgggcttcctggagaagaccaagaaggacctcgggctgggctccatcgcgacccagcagccggagagcaacatcctggacatcgacctccgccccgcctccgcctggaccctgtacgccgtggccacgaccttcgtgacccccatgctgcggcacagcatcgagaacagctccgtcaacgtgagcctcaccgcgatcgccaaccaggccacggtgctgatgggcctggggaagggctggcccctctccaagatggacatcggggtcccgctgctggccatcggctgctacagccaggtgaaccccatcaccctcaccgccgcgctgctgctcctggtggcccactacgccatcatcgggcccggcctgcaggccaaggcgacccgcgaggcccagaagcgggccgccgccggcatcatgaagaaccccacggtcgacgggatcaccgtgatcgacctcgacccgatcccctacgaccccaagttcgagaagcagctgggccaggtgatgctgctcatcctgtgcgtcacccaggtgctgatgatgcgcaccacgtgggcgctctgcgaggccctgaccctggccaccgggcccatctccaccctctgggagggcaacccggggcggttctggaacacgaccatcgccgtgagcatggccaacatcttccgcggctcctacctggcgggcgccgggctcctcttcagcatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtcgaccggaccctggccaaggaggggatcaagcgcggcgagacggaccaccacgccgtgagccgggggtccgcgaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacacgctgctctgcgacatcggggagtccagccccaacccgaccgtggaggccggccggaccctgcgcgtcctgaacctcgtggagaactggctgaacaacaacacccagttctgcatcaaggtgctgaacccctacatgccctccgtcatcgagaagatggaggccctgcagcggaagtacggcggggccctcgtgcgcaacccgctgagccggaacagcacccacgagatgtactgggtgtccaacgcgagcggcaacatcgtctccagcgtgaacatgatctcccgcatgctgatcaaccggttcacgatgcgccacaagaaggccacctacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacgtgggcctaccacggctcctacgagaccaagcagaccgggagcgcctccagcatggtcaacggcgtggtgcggctgctcaccaagccgtgggacgtcctgcccacggtgacccagatggccatgaccgacaccacgcccttcgggcagcagcgcgtgttcaaggagaaggtcgacacccgcacccaggagcccaaggagggcaccaagaagctgatgaagatcacggcggagtggctctggaaggagctgggcaagaagaagaccccgcggatgtgcacccgcgaggagttcacccggaaggtgcgctccaacgccgccctgggggccatcttcacggacgagaacaagtggaagtccgcccgggaggcggtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcccgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgcgatgtacgccgacgacaccgccgggtgggacacccggatcacgctcgaggacctgaagaacgaggagatggtgaccaaccacatggagggcgagcacaagaagctggccgaggcgatcttcaagctcacctaccagaacaaggtcgtgcgcgtgcagcggcccacgccccgggggacggtcatggacatcatcagccggcgcgaccagcggggctccggccaggtggggacctacggcctgaacaccttcaccaacatggaggcccagctgatccgccagatggagggggagggcgtgttcaagaacatccagcacctcacggtcaccgaggaggtggccgtgcagaactggctggcccgggtcgggcgcgagcgcctgagccggatggccatctccggcgacgactgcgtggtgaagcccctcgacgaccgcttcgcgaacgccctggccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggccaagaacatccaggcggccatcaaccaggtccggtccctcatcgggaacgaggagtacacggactacatgccgagcatgaagcgcttccggcgcgaggaggaggaggccggcgtgctgtggtga

SEQ ID NO: 9610 - RNA, 9876 nt, synthetic construct
  misc_feature 1..9876: note = derived and/or modified CDS sequence (opt1) from DENV-2__EU482465__SS-prME
  source 1..9876: mol_type = other RNA
agcgcggggatgatcatcatgctgatccccaccgtgatggccttccacctcaccacccggaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcatctgcaagcacagcatggtggaccgcggctgggggaacggctgcggcctgttcggcaagggcgggatcgtgacgtgcgccatgttcacgtgcaagaagaacatggagggcaagatcgtccagcccgagaacctggagtacaccatcgtggtgacgccccactccggggaggagcacgcggtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcaggagtccaactggatccagaaggagaccctggtgaccttcaagaacccccacgccaagaagcaggacgtcgtggtcctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcgtgaccctgatcaccggcaacatgagcttcaaggacctcgggcgggtggtcgtgatggtgggcgccaccatggccgacgacatcgggatgggcgtcacgtacctggccctgctcgcggccttcaaggtgcgccccaccttcgccgccggcctgctgctccggaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtctccatcctggccagctccctcctgaagaacgacatccccatgaccggccccctggtggccgggggcctcctgaccgtgtgctacgtcctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtcaagaagcagcgggccggggtgctctgggacgtgcccagcccgccgcccatgggcaaggcggagctggaggacggggcctaccgcatcaagcagaagggcatcctggggtacagccagatcggcgccggcgtctacaaggaggggaccttccacaccatgtggcacgtgacccggggcgccgtgctcatgcacaaggggaagcgcatcgagccctcctgggccgacgtcaagaaggacctgatcagctacggcgggggctggaagctggagggcgagtggaaggagggggaggaggtccaggtgctcgcgctggagcccggcaagaacccccgggccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccgctccggcgcctacgtcagcgccatcgcgcagaccgagaagtccaccgaggacaaccccgagatcgaggacgacatcttccggaagcgccggctgacgatcatggacctgcaccccggggccggcaagaccaagcgctacctccccgccatcgtgcgggaggccatcaagcgcgggctgcggaccctgatcctcgcgccgacccgcgtggtcgccgccgagatggaggaggccctgcggggcctgcccatccgctaccagacgcccgccatccgggcggagcacaccgggcgcgagatcgtggacctcatgtgccacgccaccttcaccatgcgcctgctgagccccgtgcgggtcccgaactacaacctcatcatcatggacgaggcccacttcacggaccccgcctccatcgccgcgcgcggctacatcagcacccgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgacggacttcaagggcaagaccgtctggttcgtgccgagcatcaaggcggggaacgacatcgccgcctgcctgcggaagaacggcaagaaggtgatccagctgtcccgcaagaccttcgacagcgagtacgtcaagacccggacgaacgactgggacttcgtggtgaccaccgacatctccgagatgggcgccaacttcaaggcggagcgcgtcatcgacccccggcgctgcatgaagcccgtgatcctcaccgacggggaggagcgggtgatcctggccggccccatgccggtcacgcacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgacgctcaacctgatcaccgagatgggccggctgcccaccttcatgacccagaagacgcgcgacgccctcgacaacctggccgtgctgcacaccgccgaggccggcgggcgggcctacaaccacgccctctccgagctgcccgagaccctggagaccctcctgctgctcacgctgctggccaccgtcaccgggggcatcttcctcttcctgatgagcggccgcgggatcggcaagatgaccctggggatgtgctgcatcaccacggcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgaccgtggtggccgcgacgatggccaacgagatgggcttcctggagaagaccaagaaggacctcgggctgggctccatcgccacccagcagccggagagcaacatcctggacatcgacctccgccccgcctccgcctggaccctgtacgcggtcgccacgaccttcgtgacccccatgctgcggcacagcatcgagaacagctccgtgaacgtcagcctcaccgccatcgccaaccaggccacggtgctgatgggcctggggaagggctggcccctctccaagatggacatcggggtgccgctgctggcgatcggctgctacagccaggtcaaccccatcaccctcaccgccgccctgctgctcctggtggcccactacgcgatcatcgggcccggcctgcaggccaaggccacccgcgaggcccagaagcgggccgcggccggcatcatgaagaaccccacggtggacgggatcaccgtcatcgacctcgacccgatcccctacgaccccaagttcgagaagcagctgggccaggtgatgctgctcatcctgtgcgtgacccaggtcctgatgatgcgcaccacgtgggccctctgcgaggccctgaccctggccaccgggcccatctccaccctctgggagggcaacccggggcggttctggaacacgaccatcgcggtgagcatggccaacatcttccgcggctcctacctggccggcgccgggctcctcttcagcatcatgaagaacaccaccaacacgcggcgcggcaccgggaacatgggcgagaccctgggcgagaagtggaagtcccgcctgaacgccctcgggaagtccgagttccagatctacaagcggtccggcatccaggaggtggaccgcaccctggcgaaggaggggatcaagcggggcgagacggaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacctacgggtggaacctcgtgcggctgcagagcggcgtggacgtcttcttcatcccgcccgagaagtgcgacacgctgctctgcgacatcggggagtccagccccaacccgaccgtggaggccggccgcaccctgcgggtgctgaacctcgtcgagaactggctgaacaacaacacccagttctgcatcaaggtgctgaacccctacatgccctccgtgatcgagaagatggaggcgctgcagcgcaagtacggcggggccctcgtccggaacccgctgagccgcaacagcacccacgagatgtactgggtgtccaacgccagcggcaacatcgtgtccagcgtcaacatgatctcccggatgctgatcaaccgcttcacgatgcggcacaagaaggccacctacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacgtgggcctaccacggctcctacgagaccaagcagaccgggagcgcgtccagcatggtgaacggcgtcgtgcgcctgctcaccaagccgtgggacgtgctgcccacggtcacccagatggccatgaccgacaccacgcccttcgggcagcagcgcgtgttcaaggagaaggtggacacccggacccaggagcccaaggagggcaccaagaagctgatgaagatcacggccgagtggctctggaaggagctgggcaagaagaagaccccgcgcatgtgcacccgggaggagttcacccgcaaggtccggtccaacgccgccctgggggcgatcttcacggacgagaacaagtggaagtccgcccgcgaggccgtggaggactcccggttctgggagctcgtggacaaggagcgcaacctgcacctggagggcaagtgcgagacctgcgtctacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtggagggggagggcctccacaagctggggtacatcctgcgggacgtcagcaagaaggagggcggcgccatgtacgccgacgacaccgcggggtgggacacccgcatcacgctcgaggacctgaagaacgaggagatggtgaccaaccacatggagggcgagcacaagaagctggccgaggccatcttcaagctcacctaccagaacaaggtggtccgggtgcagcgccccacgccccgggggacggtgatggacatcatcagccgccgggaccagcgcggctccgggcaggtcggcacctacggcctgaacaccttcaccaacatggaggcccagctgatccggcagatggagggggagggcgtgttcaagaacatccagcacctcacggtgaccgaggaggtcgccgtgcagaactggctggcgcgcgtggggcgcgagcggctgagccgcatggccatctccggcgacgactgcgtcgtgaagcccctcgacgaccggttcgccaacgccctgaccgccctgaacgacatgggcaagatccgcaaggacatccagcagtgggagccgagcaaggggtggaacgactggacccaggtgcccttctgctcccaccacttccacgagctcatcatgaaggacggccgggtcctggtggtgccctgccgcaaccaggacgagctgatcgggcgggcgcgcatcagccagggcgccgggtggtccctccgggagacggcctgcctgggcaagagctacgcccagatgtggtccctgatgtacttccaccgccgggacctccgcctggccgcgaacgccatctgcagcgccgtcccctcccactgggtgccgaccagccggaccacctggtccatccacgccaagcacgagtggatgaccacggaggacatgctgaccgtgtggaaccgcgtctggatccgggagaacccctggatggaggacaagacccccgtggagagctgggaggagatcccctacctcggcaagcgcgaggaccagtggtgcgggtccctgatcggcctgaccagccgggccacgtgggcgaagaacatccaggccgccatcaaccaggtgcgctccctcatcgggaacgaggagtacaccgactacatgccgagcatgaagcggttccgccgcgaggaggaggaggccggcgtcctgtggtga

SEQ ID NO: 9611 - RNA, 9876 nt, synthetic construct
  misc_feature 1..9876: note = derived and/or modified CDS sequence (opt1) from DENV-2__EU482466__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcaccccggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagccccctgccgatgggcaaggcggagctggaggacggggcctaccgcatcaagcagaagggcatcctcgggtacagccagatcggcgccggcgtgtacaaggaggggaccttccacaccatgtggcacgtgacccggggcgccgtcctgatgcacaaggggaagcgcatcgagccctcctgggccgacgtgaagaaggacctgatcagctacggcgggggctggaagctcgagggcgagtggaaggagggggaggaggtgcaggtcctggcgctggagcccggcaagaacccgcgggccgtgcagacgaagcccggcctcttcaagaccaacaccggcaccatcggggccgtgtccctggacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaacccggagatcgaggacgacatcttccggaagcgccggctgaccatcatggacctccaccccggggccggcaagacgaagcgctacctgcccgccatcgtgcgggaggccatcaagcgcgggctgcggaccctcatcctggcgcccacccgcgtcgtggccgccgagatggaggaggccctgcggggcctcccgatccgctaccagacccccgccatccgggcggagcacacggggcgcgagatcgtggacctgatgtgccacgccaccttcaccatgcgcctgctcagccccgtccgggtgcccaactacaacctgatcatcatggacgaggcccacttcaccgacccggcctccatcgccgcgcgcggctacatcagcacgcgggtggagatgggcgaggccgccgggatcttcatgaccgccacgccgcccggcagccgcgaccccttcccgcagtccaacgcccccatcatcgacgaggagcgggagatccccgagcgcagctggaactccgggcacgagtgggtcaccgacttcaagggcaagacggtgtggttcgtgcccagcatcaaggcggggaacgacatcgccgcctgcctgcggaagaacggcaagaaggtcatccagctctcccgcaagaccttcgacagcgagtacgtgaagacccggaccaacgactgggacttcgtggtcacgaccgacatctccgagatgggcgccaacttcaaggcggagcgcgtgatcgacccgcggcgctgcatgaagcccgtgatcctgaccgacggggaggagcgggtcatcctggccggccccatgcccgtgacccacagctccgccgcccagcgccgggggcgcatcggccggaacccgaagaacgagaacgaccagtacatctacatgggggagcccctcgagaacgacgaggactgcgcccactggaaggaggcgaagatgctgctggacaacatcaacacgcccgagggcatcatccccagcatgttcgagccggagcgcgagaaggtggacgccatcgacggcgagtaccggctccgcggggaggcccgcaagaccttcgtcgacctgatgcggcgcggcgacctgcccgtgtggctcgcctacaaggtggccgcggaggggatcaactacgccgaccggcgctggtgcttcgacggcatcaagaacaaccagatcctggaggagaacgtcgaggtggagatctggaccaaggagggggagcggaagaagctgaagccccgctggctcgacgcccggatctactccgacccgctggccctgaaggagttcaaggagttcgccgcgggccgcaagagcctcaccctgaacctgatcacggagatgggccggctccccaccttcatgacccagaagacccgcgacgccctggacaacctggccgtcctccacacggccgaggccggcgggcgggcctacaaccacgccctgtccgagctgcccgagaccctcgagaccctgctgctcctgaccctgctcgccacggtgaccgggggcatcttcctgttcctgatgagcggccgcgggatcggcaagatgaccctcgggatgtgctgcatcatcaccgcctccatcctgctgtggtacgcgcagatccagccccactggatcgccgccagcatcatcctcgagttcttcctgatcgtgctgctcatcccggagcccgagaagcagcggacgccccaggacaaccagctgacgtacgtcgtgatcgccatcctgaccgtggtcgccgcgaccatggccaacgagatgggcttcctcgagaagaccaagaaggacctggggctgggctccatcgccacgcagcagcccgagagcaacatcctcgacatcgacctgcgcccggcctccgcctggaccctgtacgcggtggccaccaccttcgtgacgcccatgctccggcacagcatcgagaacagctccgtcaacgtgagcctgaccgccatcgccaaccaggccaccgtgctgatgggcctcgggaagggctggcccctgtccaagatggacatcggggtccccctgctcgcgatcggctgctacagccaggtgaacccgatcaccctgacggccgccctgctcctgctggtggcccactacgcgatcatcgggcccggcctccaggccaaggccacccgcgaggcccagaagcgggccgcggccggcatcatgaagaaccccaccgtcgacgggatcaccgtgatcgacctggaccccatcccgtacgaccccaagttcgagaagcagctgggccaggtgatgctcctgatcctgtgcgtcacccaggtgctcatgatgcgcaccacctgggccctgtgcgaggccctgaccctcgccacggggcccatctccaccctgtgggagggcaaccccgggcggttctggaacaccaccatcgcggtgagcatggccaacatcttccgcggctcctacctggccggcgccgggctcctgttcagcatcatgaagaacacgaccaacacccggcgcggcaccgggaacatgggcgagacgctgggcgagaagtggaagtcccgcctcaacgccctggggaagtccgagttccagatctacaagaagtccggcatccaggaggtcgaccggaccctggcgaaggaggggatcaagcgcggcgagaccgaccaccacgccgtgagccgggggtccgccaagctccgctggttcgtggagcggaacatggtcaccccggagggcaaggtggtggacctgggctgcgggcgcggcgggtggagctactactgcggcgggctgaagaacgtccgggaggtgaagggcctcacgaagggcgggcccggccacgaggagcccatccccatgtccacctacgggtggaacctggtgcgcctgcagagcggcgtcgacgtgttcttcatcccgcccgagaagtgcgacaccctcctgtgcgacatcggggagtccagccccaaccccaccgtggaggccggccggacgctgcgcgtcctcaacctggtggagaactggctgaacaacaacacccagttctgcatcaaggtgctgaacccgtacatgccctccgtcatcgagaagatggaggcgctccagcggaagtacggcggggccctggtgcgcaaccccctgagccggaacagcacccacgagatgtactgggtgtccaacgccagcggcaacatcgtctccagcgtgaacatgatctcccgcatgctcatcaaccggttcaccatgcgccacaagaaggccacctacgagccggacgtggacctggggagcggcacgcggaacatcgggatcgagtccgagacccccaacctggacatcatcggcaagcgcatcgagaagatcaagcaggagcacgagaccagctggcactacgaccaggaccacccctacaagacctgggcctaccacggctcctacgagacgaagcagaccgggagcgcgtccagcatggtcaacggcgtggtgcggctcctgaccaagccctgggacgtcctgccgaccgtgacgcagatggccatgaccgacaccacccccttcgggcagcagcgcgtgttcaaggagaaggtcgacacgcgcacccaggagcccaaggagggcaccaagaagctcatgaagatcaccgccgagtggctgtggaaggagctgggcaagaagaagacgccccggatgtgcacccgcgaggagttcacccggaaggtgcgctccaacgccgccctcggggcgatcttcaccgacgagaacaagtggaagtccgcccgggaggccgtggaggactcccgcttctgggagctggtcgacaaggagcggaacctgcacctcgagggcaagtgcgagacgtgcgtgtacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttctcccgggagaacagcctctccggcgtcgagggggagggcctgcacaagctggggtacatcctccgcgacgtgagcaagaaggagggcggcgccatgtacgccgacgacaccgcggggtgggacacccggatcaccctggaggacctgaagaacgaggagatggtgacgaaccacatggagggcgagcacaagaagctcgccgaggccatcttcaagctgacctaccagaacaaggtcgtgcgcgtgcagcggccgacgccccgggggaccgtcatggacatcatcagccggcgcgaccagcggggctccggccaggtggggacgtacggcctgaacaccttcaccaacatggaggcccagctcatccgccagatggagggggagggcgtgttcaagaacatccagcacctgaccgtcacggaggaggtggccgtgcagaactggctggcgcgggtcgggcgcgagcgcctcagccggatggccatctccggcgacgactgcgtggtgaagcccctggacgaccgcttcgccaacgccctgaccgccctcaacgacatgggcaagatccggaaggacatccagcagtgggagcccagcaaggggtggaacgactggacccaggtcccgttctgctcccaccacttccacgagctgatcatgaaggacggccgcgtgctggtggtcccctgccggaaccaggacgagctcatcgggcgcgcgcggatcagccagggcgccgggtggtccctgcgcgagaccgcctgcctgggcaagagctacgcccagatgtggtccctcatgtacttccaccggcgcgacctgcggctggccgcgaacgccatctgcagcgccgtgccctcccactgggtgcccacgagccgcaccacctggtccatccacgccaagcacgagtggatgaccaccgaggacatgctcacggtctggaaccgggtgtggatccgcgagaacccgtggatggaggacaagacccccgtggagagctgggaggagatcccctacctgggcaagcgggaggaccagtggtgcgggtccctgatcggcctcaccagccgcgccacctgggcgaagaacatccaggccgccatcaaccaggtccggtccctgatcgggaacgaggagtacacggactacatgcccagcatgaagcgcttccggcgcgaggaggaggaggccggcgtgctgtggtga

SEQ ID NO: 9612 - RNA, 9876 nt, synthetic construct
  misc_feature 1..9876: note = derived and/or modified CDS sequence (opt1) from DENV-2__EU482467__SS-prME
  source 1..9876: mol_type = other RNA
agcgcgggcatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacatcaagacccggaccaacgactgggacttcgtggtgacgaccgacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtcaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtggtcatcgccatcctgaccgtggtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtcgccaccaccttcgtgacgcccatgctgcggcacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcaccctcacggccgccctgctgctcctggtggcccactacgcgatcatcgggcccggcctgcaggccaaggccacccgcgaggcccagaagcgggccgcggccggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgacgaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgaccgtggaggccggccggacgctgcgcgtgctgaacctcgtcgagaactggctgaacaacaacacccagttctgcatcaaggtgctgaacccctacatgccctccgtgatcgagaagatggaggcgctgcagcggaagtacggcggggccctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcaccgcaagctggccgaggccatcttcaagctcacgtaccagaacaaggtggtccgggtgcagcgccccacgccccgggggaccgtgatggacatcatcagccgccgggaccagcgcggctccgggcaggtcggcacctacggcctgaacacgttcaccaacatggaggcccagctgatccggcagatggagggggagggcgtgttcaagaacatccaccacctcaccgtgaccgaggaggtcgccgtgcagaactggctggcgcgcgtggggcgcgagcggctgagccgcatggccatctccggcgacgactgcgtcgtgaagcccctcgacgaccggttcgccaacgccctgacggccctgaacgacatgggcaagatccgcaaggacatccagcagtgggagccgagcaaggggtggaacgactggacccaggtgcccttctgctcccaccacttccacgagctcatcatgaaggacggccgggtcctggtggtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtcccctcccactgggtgccgaccagccggacgacctggtccatccacgccaagcacgagtggatgaccaccgaggacatgctgaccgtgtggaaccgcgtctggatccgggagaacccctggatggaggacaagacgcccgtggagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacaccgactacatgccgagcatgaagcggttccgccgcgaggaggaggaggccggcgtcctgtggtga

SEQ ID NO: 9613 - RNA, 9876 nt, synthetic construct
  misc_feature 1..9876: note = derived and/or modified CDS sequence (opt1) from DENV-2__EU482468__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcatgcggcacccgggcttcacgatcatggccgcgatcctggcctacaccatcgggaccacccacttccagcgcgtcctgatcttcatcctcctgacggccgtggccccctccatgaccatgcggtgcatcggcatcagcaaccgcgacttcgtggagggcgtctccgggggcagctgggtggacatcgtgctggagcacgggtcctgcgtcaccaccatggcgaagaacaagcccacgctcgacttcgagctgatcaagaccgaggccaagcagcccgccaccctgcggaagtactgcatcgaggccaagctcaccaacacgaccaccgagagccgctgccccacccagggcgagccctccctgaaggaggagcaggacaagcggttcgtgtgcaagcacagcatggtggaccgcggctgggggaacggctgcgggctgttcggcaagggcgggatcgtcacgtgcgccatgttcacgtgcaagaagaacatggagggcaagatcgtgcagcccgagaacctcgagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctggacttcaacgagatggtgctcctgcagatggagaacaaggcctggctggtgcaccgccagtggttcctcgacctgcccctgccctggctcccgggggccgacaagcaggagtccaactggatccagaaggagaccctggtcaccttcaagaacccccacgccaagaagcaggacgtggtcgtgctgggcagccaggagggggcgatgcacacggccctcaccggcgccaccgagatccagatgagctccgggaacctgctgttcaccggccacctcaagtgccggctgcgcatggacaagctgcagctcaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctgggccggctcatcaccgtgaacccgatcgtgacggagaaggactcccccgtcaacatcgaggccgagccgcccttcggggacagctacatcatcatcggcgtggagccggggcagctgaagctgaactggttcaagaagggctccagcatcgggcagatgttcgagaccaccatgcgcggcgcgaagcgcatggccatcctcggcgacaccgcctgggacttcgggtccctgggcggggtgttcacgagcatcggcaaggccctgcaccaggtcttcggggccatctacggcgcggccttctccggcgtgagctggaccatgaagatcctcatcggggtgatcatcacctggatcggcatgaactcccggagcacctccctgagcgtctccctggtgctggtggggatcgtcacgctctacctgggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctcgccagcgcgatccagaaggcccaggaggaggggatctgcggcatccgctccgtcacgcggctggagaacctgatgtggaagcagatcacccccgagctcaaccacatcctggccgagaacgaggtgaagctgaccatcatgaccggggacatccgcggcatcatgcaggccgggaagcggagcctccgcccgcagcccacggagctgaagtactcctggaagacctggggcaaggccaagatgctgagcaccgagtcctacaaccagaccttcctcatcgacggccccgagacggcggagtgcccgaacaccaaccgggcctggaacagcctggaggtggaggactacgggttcggcgtcttcaccaccaacatctggctgaagctcaaggagaagcaggacgccttctgcgactccaagctgatgagcgccgccatcaaggacaaccgcgcggtgcacgccgacatggggtactggatggagtccgccctgaacgacacgtggaagatcgagaaggccagcttcatcgaggtgaagaactgccactggcccaagtcccacaccctctggagcaacggcgtcctggagtccgagatgatcatccccaagaacctggccggccccgtgagccagcacaactaccggccggggtaccacacccagatcgcgggcccctggcacctcgggaagctggagatggacttcgacttctgcgacggcaccaccgtgatcgtcacggaggactgcgggaaccgcggcccctccctgcggaccaccaccgccagcggcaagctcatcacggagtggtgctgccgcagctgcaccctgcccccgctgcggtaccgcggggaggacggctgctggtacgggatggagatccggcccctcaaggagaaggaggagaacctggtgaactccctggtgaccgccggccacgggcaggtcgacaacttcagcctcggcgtgctgggcatggccctgttcctcgaggagatgctgcgcacccgggtggggacgaagcacgcgatcctgctcgtcgccgtgtccttcgtgaccctgatcaccggcaacatgagcttcaaggacctggggcgcgtcgtggtgatggtcggcgccaccatggccgacgacatcgggatgggcgtgacgtacctcgccctgctggcggccttcaaggtgcggcccaccttcgccgccggcctcctgctgcgcaagctcacctccaaggagctgatgatgaccacgatcgggatcgtcctgctcagccagtccaccatccccgagaccgtgctggagctgaccgacgccctcgcgctgggcatgatggtgctgaagatcgtccgcaacatggagaagtaccagctcgccgtgacgatcatggccatcctgtgcgtcccgaacgccgtgatcctgcagaacgcctggaaggtgagctgcaccatcctcgcggtcgtgtccgtgagccccctgctgctcacctccagccagcagaagaccgactggatccccctggccctgacgatcaaggggctcaaccccaccgccatcttcctgaccaccctgtcccggacgaacaagaagcgcagctggccgctcaacgaggccatcatggcggtcggcatggtgtccatcctggccagctccctgctcaagaacgacatccccatgaccggccccctggtggccgggggcctgctcaccgtctgctacgtgctgaccgggcggagcgccgacctggagctcgagcgcgccacggacgtgaagtgggaggaccaggcggagatctccggcagcagccccatcctgtccatcaccatcagcgaggacgggtccatgagcatcaagaacgaggaggaggagcagaccctgaccatcctcatccggacgggcctgctggtcatctccggcctcttcccgatcagcatccccatcaccgccgccgcctggtacctgtgggaggtgaagaagcagcgcgccggggtgctgtgggacgtccccagcccgccgcccatgggcaaggcggagctcgaggacggggcctaccggatcaagcagaagggcatcctggggtacagccagatcggcgccggcgtgtacaaggaggggaccttccacaccatgtggcacgtgacccgcggcgccgtcctgatgcacaaggggaagcggatcgagccctcctgggccgacgtgaagaaggacctcatcagctacggcgggggctggaagctggagggcgagtggaaggagggggaggaggtgcaggtcctggcgctcgagcccggcaagaacccccgcgccgtgcagacgaagcccgggctgttcaagaccaacaccggcaccatcggggccgtgtccctggacttcagccccggcacgtccggcagccccatcatcgacaagaaggggaaggtcgtgggcctctacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctgcccgccatcgtgcgcgaggccatcaagcgggggctccgcaccctgatcctggcgccgacccgggtcgtggccgccgagatggaggaggccctccgcggcctgcccatccggtaccagacccccgccatccgcgcggagcacacggggcgcgagatcgtggacctgatgtgccacgccaccttcaccatgcggctcctgagccccgtccgcgtgccgaactacaacctgatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctccgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctgaccgacggggaggagcgcgtcatcctcgccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacgcccgagggcatcatcccgagcatgttcgagcccgagcgggagaaggtggacgccatcgacggcgagtaccgcctgcgcggggaggcccggaagaccttcgtcgacctgatgcgccggggcgacctccccgtgtggctggcctacaaggtggccgcggaggggatcaactacgccgaccgccggtggtgcttcgacggcatcaagaacaaccagatcctggaggagaacgtcgaggtggagatctggaccaaggagggggagcgcaagaagctcaagccgcggtggctggacgcccgcatctactccgaccccctggccctcaaggagttcaaggagttcgccgcgggccggaagtccctgaccctgaacctcatcacggagatgggccgcctgcccaccttcatgacccagaagacccgggacgccctggacaacctcgccgtcctgcacacggccgaggccggcgggcgcgcctacaaccacgccctgtccgagctccccgagaccctggagaccctgctcctgctgaccctcctggccacggtgaccgggggcatcttcctgttcctcatgagcggccgggggatcggcaagatgaccctggggatgtgctgcatcatcaccgcctccaccctgctctggtacgcgcagatccagccgcactggatcgccgccagcatcatcctggagttcttcctgatcgtgctcctgatccccgagcccgagaagcagcgcacgccccaggacaaccagctgacctacgtcgtgatcgccatcctcaccgtggtcgccgcgaccatggccaacgagatgggcttcctggagaagacgaagaaggacctggggctcggctccatcgccacccagcagccggagagcaacatcctggacatcgacctgcggcccgcctccgcctggaccctctacgcggtggccaccacgttcgtgacccccatgctgcgccacagcatcgagaacagctccgtcaacgtgagcctgaccgccatcgccaaccaggccaccgtgctcatgggcctggggaagggctggcccctgtccaagatggacatcggggtcccgctcctggcgatcggctgctacagccaggtgaaccccatcacgctgaccgccgccctcctgctgctcgtggcccactacgcgatcatcgggcccggcctgcaggccaaggccacccgggaggcccagaagcgcgccgcggccggcatcatgaagaaccccaccgtcgacgggatcacggtgatcgacctggacccgatcccctacgaccccaagttcgagaagcagctcggccaggtgatgctgctgatcctctgcgtcacccaggtgctgatgatgcggaccacctgggccctgtgcgaggccctcacgctggccaccgggcccatctccaccctgtgggagggcaacccggggcgcttctggaacaccacgatcgcggtgagcatggccaacatcttccggggctcctacctcgccggcgccgggctgctgttcagcatcatgaagaacaccaccaacacccgccgcggcacggggaacatcggcgagaccctcggcgagaagtggaagtcccggctgaacgccctgggcaagagcgagttccagatctacaagaagtccggcatccaggaggtcgaccgcaccctcgcgaaggaggggatcaagcggggcgagaccgaccaccacgccgtgagccgcgggtccgccaagctgcggtggttcgtggagcgcaacatggtcacgcccgagggcaaggtggtggacctgggctgcgggcggggcgggtggagctactactgcggcgggctcaagaacgtccgcgaggtgaagggcctgaccaagggcgggcccggccacgaggagcccatcccgatgtccacctacgggtggaacctggtgcggctccagagcggcgtcgacgtgttcttcatcccgcccgagaagtgcgacaccctgctgtgcgacatcggggagtccagccccaacccgacggtggaggccggccgcaccctccgggtcctgaacctggtggagaactggctcaacaacaacacccagttctgcatcaaggtgctgaacccctacatgccctccgtcatcgagaagatggaggcgctgcagcgcaagtacggcggggccctggtgcggaacccgctcagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctggggagcggcacccgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagacgaagcagaccgggagcgcgtccagcatggtcaacggcgtggtgcgcctgctgaccaagccgtgggacgtcctccccaccgtgacgcagatggccatgaccgacaccacccccttcgggcagcagcgcgtgttcaaggagaaggtcgacacgcggacccaggagcccaaggagggcaccaagaagctgatgaagatcaccgccgagtggctgtggaaggagctcggcaagaagaagacgccgcgcatgtgcacccgggaggagttcacccgcaaggtgcggtccaacgccgccctgggggcgatcttcaccgacgagaacaagtggaagtccgcccgcgaggccgtggaggactcccggttctgggagctggtcgacaaggagcgcaacctccacctggagggcaagtgcgagacgtgcgtgtacaacatgatggggaagcgggagaagaagctgggcgagttcgggaaggccaagggcagccgcgccatctggtacatgtggctcggcgcgcggttcctggagttcgaggccctggggttcctcaacgaggaccactggttctcccgcgagaacagcctgtccggcgtcgagggggagggcctgcacaagctcgggtacatcctgcgggacgtgagcaagaaggagggcggcgccatgtacgccgacgacaccgcggggtgggacacccgcatcaccctggaggacctcaagaacgaggagatggtgacgaaccacatggagggcgagcacaagaagctggccgaggccatcttcaagctgacctaccagaacaaggtcgtgcgggtgcagcgccccacgccccgggggaccgtcatggacatcatcagccgccgggaccagcgcggctccggccaggtgggcacgtacggcctcaacaccttcaccaacatggaggcccagctgatccggcagatggagggggagggcgtgttcaagaacatccagcacctgaccgtcacggaggaggtggccgtgcacaactggctcgcgcgcgtcgggcgcgagcggctgagccgcatggccatctccggcgacgactgcgtggtgaagcccctggacgaccggttcgccaacgccctcaccgccctgaacgacatgggcaagatccgcaaggacatccagcagtgggagccgagcaaggggtggaacgactggacccaggtccccttctgctcccaccacttccacgagctgatcatgaaggacggccgggtgctcgtggtcccctgccgcaaccaggacgagctgatcgggcgggcgcgcatcagccagggcgccgggtggtccctgcgggagaccgcctgcctcggcaagagctacgcccagatgtggtccctgatgtacttccaccgccgggacctgcgcctcgccgcgaacgccatctgcagcgccgtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctgggcaagcgcgaggaccagtggtgcgggtccctcatcggcctgaccagccgggccacctgggcgaagaacatccaggccgccatcaaccaggtccgctccctgatcgggaacgaggagtacacggactacatgccgagcatgaagcggttccgccgcgaggaggaggaggccggcgtgctctggtga

SEQ ID NO: 9614 - RNA, 9876 nt, synthetic construct
  misc_feature 1..9876: note = derived and/or modified CDS sequence (opt1) from DENV-2__EU482469__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcccacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagaacatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgtcccccgtccgcgtgccgaactacaacctcatcatcatggacgaggcccacttcaccgaccccgccagcatcgccgcgcggggctacatctccacgcgcgtggagatgggcgaggccgccgggatcttcatgaccgccacgccgcccggcagccgggacccgttcccccagagcaacgcccccatcatcgacgaggagcgcgagatccccgagcggtcctggaacagcgggcacgagtgggtcaccgacttcaagggcaagacggtgtggttcgtgccgtccatcaaggcggggaacgacatcgccgcctgcctgcgcaagaacggcaagaaggtcatccagctgagccggaagaccttcgactccgagtacgtgaagacccgcaccaacgactgggacttcgtggtcacgaccgacatcagcgagatgggcgccaacttcaaggcggagcgggtgatcgacccccgccggtgcatgaagcccgtgatcctcaccgacggggaggagcgcgtcatcctggccggccccatgccggtgacccactccagcgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgtccatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctcagcgagctgcccgagaccctggagaccctcctgctgctcaccctgctggccacggtgaccgggggcatcttcctcttcctgatgtccggccgggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggcagcatcgccacgcagcagccggagtccaacatcctggacatcgacctccggcccgccagcgcctggaccctgtacgcggtggccaccaccttcgtgacgcccatgctgcgccactccatcgagaacagcagcgtcaacgtgtccctcaccgccatcgccaaccaggccaccgtgctgatgggcctggggaagggctggcccctcagcaagatggacatcggggtcccgctgctggcgatcggctgctactcccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatcagcaccctctgggagggcaacccggggcgcttctggaacaccaccatcgcggtgtccatggccaacatcttccggggcagctacctggccggcgccgggctcctcttctccatcatgaagaacacgaccaacacccgccgcggcaccgggaacacgggcgagaccctgggcgagaagtggaagtcccggctgaacgccctcgggaagtccgagttccagatctacaagaagtccggcatccaggaggtcgaccgcaccctggcgaaggaggggatcaagcggggcgagaccgaccaccacgccgtgtcccgcgggagcgccaagctgcggtggttcgtggagcgcaacatggtcacgcccgagggcaaggtggtggacctcggctgcgggcggggcgggtggtcctactactgcggcgggctgaagaacgtccgcgaggtgaagggcctgaccaagggcgggcccggccacgaggagcccatcccgatgagcacctacgggtggaacctcgtgcggctgcagtccggcgtcgacgtgttcttcatcccgcccgagaagtgcgacaccctgctctgcgacatcggggagagctcccccaacccgacggtggaggccggccgcaccctgcgggtcctgaacctcgtggagaactggctgaacaacaacacccagttctgcatcaaggtgctgaacccctacatgcccagcgtcatcgagaagatggaggcgctgcagcgcaagtacggcggggccctcgtgcggaacccgctgtcccgcaacagcacccacgagatgtactgggtgagcaacgcctccggcaacatcgtcagctccgtgaacatgatcagccggatgctgatcaaccgcttcaccatgcggcacaagaaggccacgtacgagcccgacgtggacctcgggtccggcacccgcaacatcgggatcgagagcgagatccccaacctggacatcatcggcaagcggatcgagaagatcaagcaggagcacgagacctcctggcactacgaccaggaccacccctacaagacctgggcctaccacggcagctacgagacgaagcagaccgggtccgcgagctccatggtcaacggcgtggtgcgcctgctcaccaagccgtgggacgtcctgcccaccgtgacgcagatggccatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgcatgtgcacccgggaggagttcaccaagaaggtgcgcagcaacgccgccctgggggcgatcttcaccgacgagaacaagtggaagtccgcccgggaggccgtggaggacagccgcttctgggagctcgtcgacaaggagcggaacctgcacctggagggcaagtgcgagacgtgcgtgtacaacatgatggggaagcgcgagaagaagctcggcgagttcgggaaggccaagggctcccgggccatctggtacatgtggctgggcgcgcgcttcctggagttcgaggccctcgggttcctgaacgaggaccactggttcagccgggagaactccctgagcggcgtcgagggggagggcctccacaagctggggtacatcctgcgcgacgtgtccaagaaggagggcggcgccatgtacgccgacgacaccgcggggtgggacacccggatcaccctcgaggacctgaagaacgaggagatggtgacgaaccacatggagggcgagcacaagaagctggccgaggccatcttcaagctcacctaccagaacaaggtcgtgcgcgtgcagcggcccacgccccgcgggaccgtcatggacatcatcagccggcgcgaccagcggggcagcggccaggtgggcacgtacggcctgaacaccttcaccaacatggaggcccagctgatccgccagatggagggggagggcgtgttcaagaacatccagcacctcaccgtcacggaggaggtggccgtgcacaactggctggcgcgggtcgggcgcgagcgcctgtcccggatggccatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcatcctggtggtgccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtccccagccactgggtgccgacgtcccgcaccacctggagcatccacgccaagcacgagtggatgaccaccgaggacatgctgacggtgtggaaccgggtctggatccgcgagaacccctggatggaggacaagacccccgtggagtcctgggaggagatcccctacctcggcaagcgggaggaccagtggtgcgggagcctgatcggcctgacctcccgcgccacctgggcgaagaacatccaggccgccatcaaccaggtgcggagcctcatcgggaacgaggagtacacggactacatgccgtccatgaagcgcttccggcgcgaggaggaggaggccggcgtcctgtggtga

SEQ ID NO: 9615 - RNA, 9876 nt, synthetic construct
  misc_feature 1..9876: note = derived and/or modified CDS sequence (opt1) from DENV-2__EU482470__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatgaccatcctgtgcgtcccgaacgccgtgatcctccagaacgcctggaaggtgagctgcaccatcctggccgtcgtgtccgtgagccccctgctcctgacctccagccgccagaagacggactggatccccctggcgctcaccatcaaggggctgaaccccaccgccatcttcctgaccacgctctcccggaccaacaagaagcgcagctggccgctgaacgaggccatcatggccgtcggcatggtgtccatcctggcgagctccctcctgaagaacgacatccccatgaccggccccctggtggccgggggcctcctgaccgtctgctacgtgctgacggggcggagcgccgacctcgagctggagcgcgccaccgacgtgaagtgggaggaccaggccgagatctccggcagcagccccatcctgtccatcaccatcagcgaggacgggtccatgagcatcaagaacgaggaggaggagcagaccctcacgatcctgatccggaccggcctgctcgtcatctccggcctgttcccgatcagcatccccatcaccgcggccgcctggtacctgtgggaggtgaagaagcagcgcgccggggtgctctgggacgtccccagcccgccgcccatgggcaaggccgagctggaggacggggcgtaccggatcaagcagaagggcatcctggggtacagccagatcggcgccggcgtgtacaaggaggggaccttccacaccatgtggcacgtgacgcgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccggtccggcgcctacgtgagcgccatcgcccagaccgagaagtccatcgaggacaaccccgagatcgaggacgacatcttccgcaagcggcgcctgacgatcatggacctgcaccccggggcgggcaagaccaagcggtacctccccgccatcgtgcgcgaggccatcaagcgggggctgcgcaccctgatcctcgccccgacccgggtcgtggcggccgagatggaggaggccctgcgcggcctgcccatccggtaccagacgcccgccatccgcgccgagcacaccgggcgcgagatcgtggacctcatgtgccacgcgaccttcaccatgcggctgctgagccccgtccgcgtgccgaactacaacctcatcatcatggacgaggcccacttcacggaccccgcctccatcgccgcccggggctacatcagcacccgcgtggagatgggcgaggcggccgggatcttcatgaccgccacgccgcccggcagccgggacccgttcccccagtccaacgcccccatcatcgacgaggagcgcgagatccccgagcggagctggaactccgggcacgagtgggtcacggacttcaagggcaagaccgtgtggttcgtgccgagcatcaaggccgggaacgacatcgcggcctgcctgcgcaagaacggcaagaaggtcatccagctgtcccggaagaccttcgacagcgagtacgtgaagacccgcacgaacgactgggacttcgtggtcaccaccgacatctccgagatgggcgccaacttcaaggccgagcgggtgatcgacccccgccggtgcatgaagcccgtgatcctcaccgacggggaggagcgcgtcatcctggcgggccccatgccggtgacgcacagctccgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgcgatcgacggcgagtaccgcctgcgcggggaggcccggaagaccttcgtcgacctcatgcgccggggcgacctgcccgtgtggctggcctacaaggtggccgccgaggggatcaactacgcggaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgccggccggaagtccctgacgctcaacctgatcaccgagatgggccgcctgcccaccttcatgacccagaagacgcgggacgcgctcgacaacctggccgtcctgcacaccgccgaggccgggggccgcgcgtacaaccacgccctctccgagctgcccgagaccctggagaccctcctgctgctcacgctgctggccaccgtgaccgggggcatcttcctcttcctgatgagcggccgggggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgaccgtggtcgccgccaccatggcgaacgagatgggcttcctggagaagacgaagaaggacctcgggctgggctccatcgccacccagcagccggagagcaacatcctggacatcgacctccggcccgcctccgcctggaccctgtacgccgtggcgaccacgttcgtgacccccatgctgcgccacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcacgctcaccgcggccctgctgctcctggtggcccactacgccatcatcgggcccggcctgcaggcgaaggccacccgggaggcccagaagcgcgccgccgcgggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcggaccacctgggccctctgcgaggccctgacgctggccaccgggcccatctccaccctctgggagggcaacccggggcgcttctggaacaccacgatcgccgtgagcatggcgaacatcttccggggctcctacctggccggcgccgggctcctcttcagcatcatgaagaacaccaccaacacccgccgcggcacggggaacatgggcgagaccctgggcgagaagtggaagtcccggctgaacgccctcggcaagagcgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacgcccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgacggtggaggccggccgcaccctgcgggtcctgaacctcgtggagaactggctgaacaacaacacccagttctgcatcaaggtgctgaacccctacatgccctccgtcatcgagaagatggaggccctgcagcgcaagtacggcggggcgctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctgctcaccaagccgtgggacgtcctgcccaccgtgacgcagatggcgatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggccatcttcaccgacgagaacaagtggaagtccgcgcgcgaggccgtggaggactccggcttctgggagctcgtcgacaaggagcggaacctgcacctggaggggaagtgcgagacgtgcgtgtacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtcgagggcgaggggctccacaagctgggctacatcctgcgcgacgtgagcaagaaggagggcggggccatgtacgccgacgacaccgccggctgggacacccggatcaccctcgaggacctgaagaacgaggagatggtgacgaaccacatggagggggagcacaagaagctggcggaggccatcttcaagctcacctaccagaacaaggtcgtgcgcgtgcagcggcccacgccccggggcaccgtcatggacatcatcagccggcgcgaccagcgggggtccggccaggtgggcacgtacgggctgaacaccttcaccaacatggaggcccagctgatccgccagatggagggcgagggggtgttcaagaacatccagcacctcaccgtcacggaggaggtggccgtgcagaactggctggcccgggtcggccgcgagcgcctgagccggatggcgatctccggcgacgactgcgtggtgaagcccctcgacgaccgcttcgccaacgccctgaccgccctgaacgacatggggaagatccggaaggacatccagcagtgggagccgagcaagggctggaacgactggacccaggtccccttctgctcccaccacttccacgagctcatcatgaaggacgggcgcgtgctggtggtcccctgccggaaccaggacgagctgatcggccgcgcccggatcagccagggggcgggctggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcgggaagcgggaggaccagtggtgcggctccctgatcgggctgaccagccgcgccacctgggccaagaacatccaggcggccatcaaccaggtccggtccctcatcggcaacgaggagtacacggactacatgccgagcatgaagcgcttccggcgcgaggaggaggaggccggggtgctgtggtga

SEQ ID NO: 9616 - RNA, 9876 nt, synthetic construct
  misc_feature 1..9876: note = derived and/or modified CDS sequence (opt1) from DENV-2__EU482471__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacagcgtgggcaacgacacggggaagcacggcatggagatcaaggtgaccccgcagtccagcatcaccgaggcggagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagagcaactggatccagaaggagaccctggtcaccttcaagaacccccacgccaagaagcaggacgtggtcgtgctcggcagccaggagggggccatgcacacggcgctgaccggcgccaccgagatccagatgtccagcgggaacctcctgttcaccggccacctgaagtgccggctgcgcatggacaagctccagctgaagggcatgtcctacagcatgtgcacggggaagttcaaggtggtcaaggagatcgccgagacccagcacggcaccatcgtgatccgggtgcagtacgagggggacggctccccctgcaagatccccttcgagatcatggacctggagaagcgctacgtcctcggccggctgatcaccgtgaacccgatcgtgacggagaaggacagccccgtcaacatcgaggccgagccgcccttcggggactcctacatcatcatcggcgtggagccggggcagctgaagctcaactggttcaagaagggcagctccatcgggcagatgttcgagaccaccatgcgcggcgccaagcgcatggcgatcctgggcgacaccgcctgggacttcgggagcctgggcggggtgttcacgtccatcggcaaggccctccaccaggtcttcggggccatctacggcgccgcgttcagcggcgtgtcctggaccatgaagatcctgatcggggtgatcatcacctggatcggcatgaacagccggtccaccagcctgtccgtcagcctggtgctcgtggggatcgtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcgcaggaggaggggatctgcggcatccgcagcgtcacgcggctggagaacctcatgtggaagcagatcacccccgagctgaaccacatcctggccgagaacgaggtgaagctcaccatcatgaccggggacatccgcggcatcatgcaggccgggaagcggtccctgcgcccgcagcccacggagctgaagtacagctggaagacctggggcaaggccaagatgctctccaccgagagctacaaccagaccttcctgatcgacggccccgagacggccgagtgcccgaacaccaaccgggcgtggaactccctggaggtggaggactacgggttcggcgtcttcaccaccaacatctggctcaagctgaaggagaagcaggacgccttctgcgacagcaagctgatgtccgccgccatcaaggacaaccgcgccgtgcacgcggacatggggtactggatcgagagcgccctcaacgacacgtggaagatcgagaaggcctccttcatcgaggtgaagaactgccactggcccaagagccacaccctgtggtccaacggcgtcctggagagcgagatgatcatccccaagaacctcgccggccccgtgtcccagcacaactaccggccggggtaccacacccagatcgccggcccctggcacctggggaagctggagatggacttcgacttctgcgacggcaccaccgtgatcgtcacggaggactgcgggaaccgcggccccagcctccggaccaccaccgcgagcggcaagctgatcacggagtggtgctgccgctcctgcaccctgcccccgctccggtaccgcggggaggacggctgctggtacgggatggagatccggcccctgaaggagaaggaggagaacctggtgaacagcctcgtgaccgccggccacgggcaggtcgacaacttctccctgggcgtgctgggcatggccctcttcctggaggagatgctgcgcacccgggtggggacgaagcacgccatcctcctggtcgcggtgagcttcgtgaccctgatcaccggcaacatgtccttcaaggacctcgggcgcgtcgtggtgatggtcggcgccaccatggccgacgacatcgggatgggcgtgacgtacctggccctgctcgccgcgttcaaggtgcggcccaccttcgccgccggcctgctgctccgcaagctgaccagcaaggagctgatgatgaccacgatcgggatcgtcctcctgtcccagagcaccatccccgagaccgtgctggagctcaccgacgccctggccctgggcatgatggtgctcaagatcgtccgcaacatggagaagtaccagctggcggtgacgatcatggccatcctgtgcgtcccgaacgccgtgatcctccagaacgcctggaaggtgtcctgcaccatcctggccgtcgtgagcgtgagccccctgctcctgaccagctcccagcagaagaccgactggatccccctggcgctcacgatcaaggggctgaaccccaccgccatcttcctgaccaccctcagccggacgaacaagaagcgctcctggccgctgaacgaggccatcatggccgtcggcatggtgagcatcctggcgtccagcctcctgaagaacgacatccccatgaccggccccctggtggccgggggcctcctgaccgtctgctacgtgctgaccgggcggtccgccgacctcgagctggagcgcgccacgaacgtgaagtgggaggaccaggccgagatcagcggcagctcccccatcctgagcatcaccatctccgaggacgggagcatgtccatcaagaacgaggaggaggagcagaccctcaccatcctgatccggacgggcctgctcgtcatcagcggcctgttcccgatctccatccccatcaccgcggccgcctggtacctgtgggaggtgaagaagcagcgcgccggggtgctctgggacgtcccctccccgccgcccatgggcaaggccgagctggaggacggggcgtaccggatcaagcagaagggcatcctggggtactcccagatcggcgccggcgtgtacaaggaggggaccttccacaccatgtggcacgtgacccgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccccgcgcggtgcagacgaagcccgggctgttcaagaccaacaccggcaccatcggggccgtgagcctcgacttctcccccggcacgagcggctcccccatcatcgacaagaaggggaaggtcgtgggcctgtacgggaacggcgtggtcacccggagcggcgcctacgtgtccgccatcgcccagaccgagaagtccatcgaggacaaccccgagatcgaggacgacatcttccgcaagcggcgcctgaccatcatggacctgcaccccggggcgggcaagacgaagcggtacctccccgccatcgtgcgcgaggccatcaagcgggggctgcgcaccctgatcctcgccccgacccgggtcgtggcggccgagatggaggaggccctgcgcggcctgcccatccggtaccagacccccgccatccgcgccgagcacacggggcgcgagatcgtggacctcatgtgccacgcgaccttcaccatgcggctgctgtcccccgtccgcgtgccgaactacaacctcatcatcatggacgaggcccacttcaccgaccccgccagcatcgccgcccggggctacatcagcacgcgcgtggagatgggcgaggcggccgggatcttcatgaccgccacgccgcccggctcccgggacccgttcccccagagcaacgcccccatcatcgacgaggagcgcgagatccccgagcggtcctggaacagcgggcacgagtgggtcaccgacttcaagggcaagacggtgtggttcgtgccgtccatcaaggccgggaacgacatcgcggcctgcctgcgcaagaacggcaagaaggtcatccagctgagccggaagaccttcgactccgagtacgtgaagacccgcaccaacgactgggacttcgtggtcacgaccgacatcagcgagatgggcgccaacttcaaggccgagcgggtgatcgacccccgccggtgcatgaagcccgtgatcctcaccgacggggaggagcgcgtcatcctggcgggccccatgccggtgacccactccagcgccgcccagcggcgcgggcggatcggccgcaaccccaagaacgagaacgaccagtacatctacatgggggagcccctggagaacgacgaggactgcgcccactggaaggaggccaagatgctcctggacaacatcaacacgcccgagggcatcatcccgtccatgttcgagcccgagcgggagaaggtggacgcgatcgacggcgagtaccgcctgcgcggggaggcccggaagaccttcgtcgacctcatgcgccggggcgacctgcccgtgtggctggcctacaaggtggccgccgaggggatcaactacgcggaccgccggtggtgcttcgacggcatcaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgccgccggccggaagtccctgaccctcaacctgatcacggagatgggccgcctgcccaccttcatgacccagaagacccgggacgcgctcgacaacctggccgtcctgcacacggccgaggccgggggccgcgcgtacaaccacgccctcagcgagctgcccgagaccctggagaccctcctgctgctcaccctgctggccacggtgaccgggggcatcttcctcttcctgatgtccggccgggggatcggcaagatgaccctggggatgtgctgcatcatcaccgccagcatcctcctgtggtacgcccagatccagccgcactggatcgcggcctccatcatcctggagttcttcctcatcgtgctgctgatccccgagcccgagaagcagcgcacgccccaggacaaccagctcacgtacgtcgtgatcgccatcctgaccgtggtcgccgccaccatggcgaacgagatgggcttcctggagaagaccaagaaggacctcgggctgggcagcatcgccacgcagcagccggagtccaacatcctggacatcgacctccggcccgccagcgcctggaccctgtacgccgtggcgaccaccttcgtgacgcccatgctgcgccacagcatcgagaactccagcgtcaacgtgtccctcaccgccatcgccaaccaggccaccgtgctgatgggcctggggaagggctggcccctcagcaagatggacatcggggtcccgctgctggccatcggctgctactcccaggtgaaccccatcaccctcacggcggccctgctgctcctggtggcccactacgccatcatcgggcccggcctgcaggcgaaggccacccgggaggcccagaagcgcgccgccgcgggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatcagcaccctctgggagggcaacccggggcgcttctggaacaccaccatcgccgtgtccatggcgaacatcttccggggcagctacctggccggcgccgggctcctcttctccatcatgaagaacacgaccaacacccgccgcggcaccgggaacatcggcgagacgctgggcgagaagtggaagtcccggctgaacgccctcgggaagtccgagttccagatctacaagaagtccggcatccaggaggtcgaccgcaccctggccaaggaggggatcaagcggggcgagaccgaccaccacgcggtgtcccgcgggagcgccaagctgcggtggttcgtggagcgcaacatggtcacccccgagggcaaggtggtggacctcggctgcgggcggggcgggtggtcctactactgcggcgggctgaagaacgtccgcgaggtgaagggcctgacgaagggcgggcccggccacgaggagcccatcccgatgagcacctacgggtggaacctcgtgcggctgcagtccggcgtcgacgtgttcttcatcccgcccgagaagtgcgacaccctgctctgcgacatcggggagagctcccccaacccgaccgtggaggccggccgcacgctgcgggtcctgaacctcgtggagaactggctgaacaacaacacccagttctgcatcaaggtgctgaacccctacatgcccagcgtcatcgagaagatggaggccctgcagcgcaagtacggcggggcgctcgtgcggaacccgctgagccgcaactccacccacgagatgtactgggtgagcaacgcctccggcaacatcgtcagctccgtgaacatgatcagccggatgctgatcaaccgcttcaccatgcggcacaagaaggccacctacgagcccgacgtggacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtcaacggcgtggtgcgcctgctcaccaagccgtgggacgtcctgcccaccgtgacccagatggcgatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggagcaacgccgccctgggggccatcttcaccgacgagaacaagtggaagtccgcgcgcgaggccgtggaggacagccggttctgggagctcgtcgacaaggagcgcaacctgcacctggagggcaagtgcgagacctgcgtgtacaacatgatggggaagcgggagaagaagctcggcgagttcgggaaggccaagggctcccgcgccatctggtacatgtggctgggcgcccggttcctggagttcgaggcgctcgggttcctgaacgaggaccactggttcagccgcgagaactccctgagcggcgtcgagggggagggcctccacaagctggggtacatcctgcgggacgtgagcaagaaggagggcggcgccatgtacgccgacgacacggccgggtgggacacccgcatcaccctcgaggacctgaagaacgaggagatggtgaccaaccacatggagggcgagcacaagaagctggcggaggccatcttcaagctcacgtaccagaacaaggtcgtgcgggtgcagcgccccacgccccgggggaccgtcatggacatcatctcccgccgggaccagcgcggcagcggccaggtgggcacctacggcctgaacacgttcaccaacatggaggcccagctgatccggcagatggagggggagggcgtgttcaagaacatccagcacctcaccgtcaccgaggaggtggccgtgcacaactggctggcccgcgtcgggcgcgagcggctgtcccgcatggcgatcagcggcgacgactgcgtggtgaagcccctcgacgaccggttcgccaacgccctgacggccctgaacgacatgggcaagatccgcaaggacatccagcagtgggagccgtccaaggggtggaacgactggacccaggtccccttctgcagccaccacttccacgagctcatcatgaaggacggccggatcctggtggtgccctgccgcaaccaggacgagctgatcgggcgggcccgcatctcccagggcgcggggtggagcctccgggagaccgcctgcctgggcaagtcctacgcccagatgtggagcctgatgtacttccaccgccgggacctccgcctggccgccaacgcgatctgctccgccgtccccagccactgggtgccgacctcccggacgacctggagcatccacgccaagcacgagtggatgaccaccgaggacatgctgaccgtgtggaaccgcgtctggatccgggagaacccctggatggaggacaagacgcccgtggagtcctgggaggagatcccctacctcggcaagcgcgaggaccagtggtgcgggagcctgatcggcctgacctcccgggccacctgggccaagaacatccaggcggccatcaaccaggtgcgcagcctcatcgggaacgaggagtacaccgactacatgccgagcatgaagcggttccgccgcgaggaggaggaggccggcgtcctgtggtga

SEQ ID NO: 9617 - RNA, 9876 nt, synthetic construct
  misc_feature 1..9876: note = derived and/or modified CDS sequence (opt1) from DENV-2__EU482472__SS-prME
  source 1..9876: mol_type = other RNA
agcgcggggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatggagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcatcatcggggccgtgtccctcgacttcagccccggcacctccggcagccccatcatcgacaagaaggggaaggtcgtgggcctgtacgggaacggcgtggtcacgcggtccggcgcctacgtgagcgccatcgcgcagaccgagaagtccatcgaggacaaccccgagatcgaggacgacatcttccgcaagcggcgcctgaccatcatggacctgcaccccggggccggcaagaccaagcggtacctccccgccatcgtgcgcgaggccatcaagcgggggctgcgcacgctgatcctcgcgccgacccgggtcgtggccgccgagatggaggaggccctgcgcggcctgcccatccggtaccagacccccgccatccgcgcggagcacaccgggcgcgagatcgtggacctcatgtgccacgccacgttcaccatgcggctgctgagccccgtccgcgtgccgaactacaacctcatcatcatggacgaggcccacttcaccgaccccgcctccatcgccgcgcggggctacatcagcacccgcgtggagatgggcgaggccgccgggatcttcatgacggccacgccgcccggcagccgggacccgttcccccagtccaacgcccccatcatcgacgaggagcgcgagatccccgagcggagctggaactccgggcacgagtgggtcaccgacttcaagggcaagaccgtgtggttcgtgccgagcatcaaggcggggaacgacatcgccgcctgcctgcgcaagaacggcaagaaggtcatccagctgtcccggaagacgttcgacagcgagtacgtgaagacccgcaccaacgactgggacttcgtggtcaccacggacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgggagaaggtggacgccatcgacggcgagtaccgcctgcgcggggaggcccggaagacgttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcaccgagatgggccgcctgcccacgttcatgacccagaagacccgggacgccctcgacaacctggccgtcctgcacaccgccgaggccggcgggcgcgcctacaaccacgccctctccgagctgcccgagacgctggagaccctcctgctgctcaccctgctggccaccgtgaccggcgggatcttcctcttcctgatgagcgggcgggggatcgggaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacctacgtcgtgatcgccatcctgacggtggtcgccgcgaccatggccaacgagatgggcttcctggagaagaccaagaaggacctcgggctgggctccatcgccacccagcagccggagagcaacatcctggacatcgacctccggcccgcctccgcctggacgctgtacgcggtggccaccaccttcgtgacccccatgctgcgccacagcatcgagaacagctccgtcaacgtgagcctcacggccatcgccaaccaggccaccgtgctgatgggcctggggaagggctggcccctctccaagatggacatcggggtcccgctgctggcgatcggctgctacagccaggtgaaccccatcaccctcaccgccgccctgctgctcctggtggcccactacgcgatcatcgggcccggcctgcaggccaaggccacgcgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggacgacctgggccctctgcgaggccctgaccctggccaccgggcccatctccacgctctgggagggcaacccggggcgcttctggaacaccaccatcgcggtgagcatggccaacatcttccggggctcctacctggccggcgccgggctcctcttcagcatcatgaagaacaccacgaacacccgccgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggcccggccacgaggagcccatcccgatgtccacgtacgggtggaacctcgtgcggctgcagagcggcgtcgacgtgttcttcatcccgcccgagaagtgcgacaccctgctctgcgacatcggggagtccagccccaacccgaccgtggaggccggccgcaccctgcgggtcctgaacctcgtggagaactggctgaacaacaacacgcagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacccgcaacatcgggatcgagtccgagatccccaacctggacatcatcggcaagcggatcgagaagatcaagcaggagcacgagacgagctggcactacgaccaggaccacccctacaagacctgggcctaccacggctcctacgagaccaagcagaccgggagcgcgtccagcatggtcaacggcgtggtgcgcctgctcacgaagccgtgggacgtcctgcccaccgtgacccagatggccatgaccgacacgacccccttcgggcagcagcgcgtgttcaaggagaaggtcgacacccggacccaggagcccaaggagggcacgaagaagctgatgaagatcaccgccgagtggctctggaaggagctgggcaagaagaagaccccgcgcatgtgcacccgggaggagttcacgcgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgcggggtgggacacgcgcatcaccctcgaggacctgaagaacgaggagatggtgaccaaccacatggagggcgagcacaagaagctggccgaggccatcttcaagctcacctaccagaacaaggtcgtgcgggtgcagcgccccacgccccgggggaccgtcatggacatcatcagccgccgggaccagcgcggctccggccaggtgggcacctacggcctgaacaccttcacgaacatggaggcccagctgatccggcagatggagggggagggcgtgttcaagaacatccagcacctcaccgtcaccgaggaggtggccgtgcacaactggctggcgcgcgtcgggcgcgagcggctgagccgcatggccatctccggcgacgactgcgtggtgaagcccctcgacgaccggttcgccaacgccctgaccgccctgaacgacatgggcaagatccgcaaggacatccagcagtgggagccgagcaaggggtggaacgactggacgcaggtccccttctgctcccaccacttccacgagctcatcatgaaggacggccgggtgctggtggtcccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtgccctcccactgggtgccgaccagccggaccacgtggtccatccacgccaagcacgagtggatgaccaccgaggacatgctgaccgtctggaaccgcgtgtggatccgggagaacccctggatggaggacaagacccccgtggagagctgggaggagatcccctacctcggcaagcgcgaggaccagtggtgcgggtccctgatcggcctgacgagccgggccacctgggcgaagaacatccaggccgccatcaaccaggtccgctccctcatcgggaacgaggagtacaccgactacatgccgagcatgaagcggttccgccgcgaggaggaggaggccggcgtgctgtggtga

SEQ ID NO: 9618 - RNA, 9876 nt, synthetic construct
  misc_feature 1..9876: note = derived and/or modified CDS sequence (opt1) from DENV-2__EU482473__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgaccgcaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccgcggcaccgggaacatgggcgagacgctgggcgagaagtggaagtcccggctgaacgccctcggcaagagcgagttccagatctacaagaagtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagacccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtcaacggcgtggtgcgcctgctcaccaagccgtgggacgtcctgcccaccgtgacgcagatggccatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacgtgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgcggggtgggacacccgcatcaccctcgaggacctgaagaacgaggagatggtgacgaaccacatggagggcgagcacaagaagctggccgaggccatcttcaagctcacctaccagaacaaggtcgtgcgggtgcagcgccccacgccccgggggaccgtcatggacatcatcagccgccgggaccagcgcggctccggccaggtggggacgtacggcctgaacaccttcaccaacatggaggcccagctgatccggcagatggagggggagggcgtgttcaagaacatccagcacctcaccgtcacggaggaggtggccgtgcagaactggctggcgcgcgtcgggcgcgagcggctgagccgcatggccatctccggcgacgactgcgtggtgaagcccctcgacgaccggttcgccaacgccctgaccgccctgaacgacatgggcaagatccgcaaggacatccagcagtgggagccgagcaaggggtggaacgactggacccaggtccccttctgctcccaccacttccacgagctcatcatgaaggacggccgggtgctggtggtcccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctcggcaagcgcgaggaccagtggtgcgggtccctgatcggcctgaccagccgggccacctgggcgaagaacatccaggtcgccatcaaccaggtgcgctccctcatcgggaacgaggagtacacggactacatgccgagcatgaagcggttccgccgcgaggaggaggaggccggcgtgctgtggtga

SEQ ID NO: 9619 - RNA, 9876 nt, synthetic construct
  misc_feature 1..9876: note = derived and/or modified CDS sequence (opt1) from DENV-2__EU482474__SS-prME
  source 1..9876: mol_type = other RNA
agcgcggggatgatcatcatgctgatccccaccgtgatggccttccacctcaccacccgcaacggggagccccacatgatcgtggggatccaggagaaggggaagtccctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccatcaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcccacaaccagaccttcctgatcgacggccccgagacggcggagtgcccgaacaccaaccgcgcctggaacagcctggaggtggaggactacgggttcggcgtgttcaccaccaacatctggctccggctgaaggagaagcaggacgccttctgcgactccaagctgatgagcgccgccatcaaggacaaccgcgcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccggccggggtaccacacccagatcgcgggcccctggcacctggggaagctggagatggacttcgacttctgcgacggcaccaccgtgatcgtgacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtcaactccctcgtgaccgccggccacggccaggtggacaacttcagcctgggcgtcctgggcatggccctcttcctggaggagatgctgcgcacccgggtggggacgaagcacgcgatcctcctggtggccgtctccttcgtgaccctgatcaccggcaacatgagcttcaaggacctcgggcgcgtggtcgtgatggtgggcgccaccatggccgacgacatcgggatgggcgtcacgtacctggccctgctcgcggccttcaaggtgcggcccaccttcgccgccggcctgctgctccgcaagctgacctccaaggagctgatgatgaccacgatcgggatcgtgctcctgagccagtccaccatccccgagaccgtcctggagctcaccgacgccctggcgctgggcatgatggtgctcaagatcgtgcgcaacatggagaagtaccagctggccgtcacgatcatggccatcctgtgcgtgccgaacgccgtcatcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtgggcatggtctccatcctggccagctccctcctgaagaacgacatccccatgaccggccccctggtggccgggggcctcctgaccgtgtgctacgtcctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtcaagaagcagcgcgccggggtgctctgggacgtgcccagcccgccgcccatgggcaaggcggagctggaggacggggcctaccggatcaagcagaagggcatcctggggtacagccagatcggcgccggcgtctacaaggaggggaccttccacaccatgtggcacgtgacccgcggcgccgtgctcatgcacaaggggaagcggatcgagccctcctgggccgacgtcaagaaggacctgatcagctacggcgggggctggaagctggagggcgagtggaaggagggggaggaggtccaggtgctcgcgctggagcccggcaagaacccccgcgccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccggtccggcgcctacgtcagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtggtcgccgccgagatggaggaggccctgcgcggcctgcccatccggtaccagacccccgccatccgcgcggagcacacggggcgcgagatcgtggacctcatgtgccacgccaccttcaccatgcggctgctgagccccgtgcgcgtcccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtctggttcgtgccgagcatcaaggcggggaacgacatcgccgcctgcctgcgcaagaacggcaagaaggtgatccagctgtcccggaagaccttcgacagcgagtacgtcaagacccgcaccaacgactgggacttcgtggtgacgaccgacatctccgagatgggcgccaacttcaaggcggagcgggtcatcgacccccgccggtgcatgaagcccgtgatcctcaccgacggggaggagcgcgtgatcctggccggccccatgccggtcacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccgtggacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcgtgaccgcctccatcctcctgtggtacgcgcagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtcacgcccatgctgcgccacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgggaggcccagaagcgcgccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggaccacctgggccctctgcgaggccctgaccctggccacggggcccatctccaccctctgggagggcaacccggggcgcttctggaacaccaccatcgcggtcagcatggccaacatcttccggggctcctacctggccggcgccgggctcctcttcagcatcatgaagaacacgaccaacacccgccgcggcaccgggaacatgggcgagacgctgggcgagaagtggaagtcccggctgaacgccctcggcaagagcgagttccagatctacaagaagtccggcatccaggaggtggaccgcaccctggcgaaggaggggatcaagcggggcgagaccgaccaccacgccgtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgacgaagggcgggcccggccacgaggagcccatcccgatgtccacctacgggtggaacctcgtccggctgcagagcggcgtggacgtgttcttcatcccgcccgagaagtgcgacaccctgctctgcgacatcggggagtccagccccaacccgaccgtcgaggccggccgcacgctgcgggtgctgaacctcgtggagaactggctgaacaacaacacccagttctgcatcaaggtcctgaacccctacatgccctccgtgatcgagaagatggaggcgctgcagcgcaagtacggcggggccctcgtgcggaacccgctgagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcgtccagcatggtgaacggcgtggtccgcctgctcaccaagccgtgggacgtgctgcccaccgtgacccagatggccatgacggacaccacccccttcgggcagcagcgcgtcttcaaggagaaggtggacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtcgaggactcccggttctgggagctcgtggacaaggagcgcaacctgcacctggagggcaagtgcgagacctgcgtctacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtggagggggagggcctccacaagctggggtacatcctgcgggacgtgagcaagaaggagggcggcgccatgtacgccgacgacacggcggggtgggacacccgcatcaccctcgaggacctgaagaacgaggagatggtcaccaaccacatggagggcgagcacaagaagctggccgaggccatcttcaagctcacgtaccagaacaaggtggtgcgggtccagcgccccacgccccgggggaccgtgatggacatcatcagccgccgggaccagcgcggctccggccaggtgggcacctacggcctgaacacgttcaccaacatggaggcccagctgatccggcagatggagggggagggcgtcttcaagaacatccagcacctcaccgtgaccgaggaggtggccgtccagaactggctggcgcgcgtggggcgcgagcggctgagccgcatggccatctccggcgacgactgcgtggtcaagcccctcgacgaccggttcgccaacgccctgacggccctgaacgacatgggcaagatccgcaaggacatccagcagtgggagccgagcaaggggtggaacgactggacccaggtgcccttctgctcccaccacttccacgagctcatcatgaaggacggccgggtgctggtcgtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacaccgactacatgccgagcatgaagcggttccgccgcgaggaggaggaggccggcgtgctgtggtga

SEQ ID NO: 9620 - RNA, 9876 nt, synthetic construct
  misc_feature 1..9876: note = derived and/or modified CDS sequence (opt1) from DENV-2__EU482475__SS-prME
  source 1..9876: mol_type = other RNA
agcgccgggatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgtcgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgccggccgcaagagcctgaccctcaacctgatcacggagatgggccggctgcccaccttcatgacccagaagacccgcgacgcgctcgacaacctggccgtgctgcacacggccgaggccgggggccgggcgtacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacgtacgtggtgatcgccatcctgaccgtcgtggccgccaccatggcgaacgagatgggcttcctggagaagaccaagaaggacctcgggctgggctccatcgccacgcagcagccggagagcaacatcctggacatcgacctccgccccgcctccgcctggaccctgtacgccgtggcgaccaccttcgtcacgcccatgctgcggcacagcatcgagaacagctccgtgaacgtgagcctcaccgccatcgccaaccaggccaccgtcctgatgggcctggggaagggctggcccctctccaagatggacatcggggtgccgctgctggccatcggctgctacagccaggtgaaccccatcaccctcacggcggccctgctgctcctggtcgcccactacgccatcatcgggcccggcctgcaggcgaaggccacccgcgaggcccagaagcgggccgccgcgggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatctccaccctctgggagggcaacccggggcggttctggaacaccaccatcgccgtcagcatggcgaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagcggtccggcatccaggaggtggaccgcaccctggccaaggaggggatcaagcggggcgagaccgaccaccacgcggtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgacgaagggcgggcccggccacgaggagcccatcccgatgtccacctacgggtggaacctcgtccggctgcagagcggcgtggacgtgttcttcatcccgcccgagaagtgcgacaccctgctctgcgacatcggggagtccagccccaacccgaccgtcgaggccggccgcacgctgcgggtgctgaacctcgtggagaactggctgaacaacaacacccagttctgcatcaaggtcctgaacccctacatgccctccgtgatcgagaagatggaggccctgcagcgcaagtacggcggggcgctcgtgcggaacccgctgagccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtggtccgcctgctcaccaagccgtgggacgtgctgcccaccgtgacccagatggcgatgacggacaccacccccttcgggcagcagcgcgtcttcaaggagaaggtggacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggccatcttcaccgacgagaacaagtggaagtccgcgcgcgaggccgtcgaggactcccggttctgggagctcgtggacaaggagcgcaacctgcacctggagggcaagtgcgagacctgcgtctacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgtccggcgtggagggggagggcctccacaagctggggtacatcctgcgggacgtgagcaagaaggagggcggcgccatgtacgccgacgacacggccgggtgggacacccgcatcaccctcgaggacctgaagaacgaggagatggtcaccaaccacatgaagggcgagcacaagaagctggcggaggccatcttcaagctcacgtaccagaacaaggtggtgcgggtccagcgccccacgccccgggggaccgtgatggacatcatcagccgccgggaccagcgcggctccggccaggtggggacctacggcctgaacacgttcaccaacatggaggcccagctgatccggcagatggagggggagggcgtcttcaagaacatccagcacctcaccgtgaccgaggaggtggccgtccagaactggctggcccgcgtggggcgcgagcggctgagccgcatggcgatctccggcgacgactgcgtggtcaagcccctcgacgaccggttcgccaacgccctgacggccctgaacgacatgggcaagatccgcaaggacatccagcagtgggagccgagcaaggggtggaacgactggacccaggtgcccttctgctcccaccacttccacgagctcatcatgaaggacggccgggtgctggtcgtgccctgccgcaaccaggacgagctgatcgggcgggcccgcatcagccagggcgcggggtggtccctccgggagaccgcctgcctgggcaagagctacgcccagatgtggtccctgatgtacttccaccgccgggacctccgcctggccgccaacgcgatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcggcaagcgcgaggaccagtggtgcgggtccctgatcggcctgaccagccgggccacctgggccaagaacatccaggcggccatcaaccaggtgcgctccctcatcgggaacgaggagtacaccgactacatgccgagcatgaagcggttccgccgcgaggaggaggaggccggcgtgctgtggtga

SEQ ID NO: 9621 - RNA, 9876 nt, synthetic construct
  misc_feature 1..9876: note = derived and/or modified CDS sequence (opt1) from DENV-2__EU482541__SS-prME
  source 1..9876: mol_type = other RNA
agcgcggggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccgccgagctgaagtactcctggaagacgtggggcaaggcgaagatgctcagcaccgagtcctacaaccagaccttcctgatcgacggccccgagaccgccgagtgcccgaacacgaaccgggcctggaacagcctggaggtggaggactacgggttcggcgtcttcaccaccaacatctggctcaagctgaaggagaagcaggacgccttctgcgactccaagctgatgagcgccgcgatcaaggacaaccgcgccgtgcacgccgacatggggtactggatcgagtccgccctcaacgacacctggaagatcgagaaggccagcttcatcgaggtgaagaactgccactggcccaagtcccacacgctgtggagcaacggcgtcctggagtccgagatgatcatccccaagaacctcgcgggccccgtgagccagcacaactaccggccggggtaccacacccagatcgccggcccctggcacctggggaagctggagatggacttcgacttctgcgacggcaccaccgtgatcgtcaccgaggactgcgggaaccgcggcccctccctccggacgaccaccgccagcggcaagctgatcaccgagtggtgctgccgcagctgcacgctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggaccaagcacgccatcctcctggtcgccgtgtccttcgtgacgctgatcaccggcaacatgagcttcaaggacctcgggcgcgtcgtggtgatggtcggcgccaccatggccgacgacatcgggatgggcgtgacctacctggcgctgctcgccgccttcaaggtgcggcccacgttcgccgccggcctgctgctccgcaagctgacctccaaggagctgatgatgaccaccatcgggatcgtcctcctgagccagtccacgatccccgagaccgtgctggagctcaccgacgcgctggccctgggcatgatggtgctcaagatcgtccgcaacatggagaagtaccagctggccgtgaccatcatggccatcctgtgcgtcccgaacgccgtgatcctccagaacgcgtggaaggtgagctgcacgatcctggccgtcgtgtccgtgagccccctgctcctgacctccagccagcagaagaccgactggatccccctggccctcaccatcaaggggctgaaccccacggccatcttcctgaccaccctctcccggaccaacaagaagcgcagctggccgctgaacgaggcgatcatggccgtcggcatggtgtccatcctggccagctccctcctgaagaacgacatccccatgacgggccccctggtggccgggggcctcctgaccgtctgctacgtgctgaccgggcggagcgccgacctcgagctggagcgcgcgaccgacgtgaagtgggaggaccaggccgagatctccggcagcagccccatcctgtccatcacgatcagcgaggacgggtccatgagcatcaagaacgaggaggaggagcagaccctcaccatcctgatccggaccggcctgctcgtcatctccggcctgttcccgatcagcatccccatcacggccgccgcctggtacctgtgggaggtgaagaagcagcgcgcgggggtgctctgggacgtccccagcccgccgcccatgggcaaggccgagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggcggacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagacgaacaccggcaccatcggggccgtgtccctcgacttcagccccggcacctccggcagccccatcatcgacaagaaggggaaggtcgtgggcctgtacgggaacggcgtggtcacgcggtccggcgcctacgtgagcgcgatcgcccagaccgagaagtccatcgaggacaaccccgagatcgaggacgacatcttccgcaagcggcgcctgaccatcatggacctgcaccccggggccggcaagaccaagcggtacctccccgccatcgtgcgcgaggcgatcaagcgggggctgcgcacgctgatcctcgccccgacccgggtcgtggccgccgagatggaggaggccctgcgcggcctgcccatccggtaccagacccccgcgatccgcgccgagcacaccgggcgcgagatcgtggacctcatgtgccacgccacgttcaccatgcggctgctgagccccgtccgcgtgccgaactacaacctcatcatcatggacgaggcccacttcaccgaccccgcctccatcgcggcccggggctacatcagcacccgcgtggagatgggcgaggccgccgggatcttcatgacggccacgccgcccggcagccgggacccgttcccccagtccaacgcgcccatcatcgacgaggagcgcgagatccccgagcggagctggaactccgggcacgagtgggtcaccgacttcaagggcaagaccgtgtggttcgtgccgagcatcaaggccgggaacgacatcgccgcctgcctgcgcaagaacggcaagaaggtcatccagctgtcccggaagacgttcgacagcgagtacgtgaagacccgcaccaacgactgggacttcgtggtcaccacggacatctccgagatgggcgcgaacttcaaggccgagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgggagaaggtggacgccatcgacggcgagtaccgcctgcgcggggaggcccggaagacgttcgtcgacctcatgcgccggggcgacctgcccgtgtggctggcctacaaggtggcggccgaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgcggccggccggaagtccctgaccctcaacctgatcaccgagatgggccgcctgcccacgttcatgacccagaagacccgggacgccctcgacaacctggccgtcctgcacaccgcggaggccgggggccgcgcctacaaccacgccctctccgagctgcccgagacgctggagaccctcctgctgctcaccctgctggccaccgtgaccggcgggatcttcctcttcctgatgagcgggcgggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacctacgtcgtgatcgccatcctgacggtggtcgcggccaccatggccaacgagatgggcttcctggagaagaccaagaaggacctcgggctgggctccatcgccacccagcagccggagagcaacatcctggacatcgacctccggcccgcctccgcgtggacgctgtacgccgtggccaccaccttcgtgacccccatgctgcgccacagcatcgagaacagctccgtcaacgtgagcctcacggccatcgccaaccaggcgaccgtgctgatgggcctggggaagggctggcccctctccaagatggacatcggggtcccgctgctggccatcggctgctacagccaggtgaaccccatcaccctcaccgccgccctgctgctcctggtggcgcactacgccatcatcgggcccggcctgcaggccaaggccacgcgggaggcccagaagcgcgcggccgccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggacgacctgggccctctgcgaggccctgaccctggcgaccgggcccatctccacgctctgggagggcaacccggggcgcttctggaacaccaccatcgccgtgagcatggccaacatcttccggggctcctacctggccggcgccgggctcctcttcagcatcatgaagaacaccacgaacacccgccgcggcaccgggaacatcggcgagaccctgggcgagaagtggaagtcccggctgaacgcgctcggcaagagcgagttccagatctacaagaagtccggcatccaggaggtcgaccgcacgctggccaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggcccggccacgaggagcccatcccgatgtccacgtacgggtggaacctcgtgcggctgcagagcggcgtcgacgtgttcttcatcccgcccgagaagtgcgacaccctgctctgcgacatcggggagtccagccccaacccgaccgtggaggcgggccgcaccctgcgggtcctgaacctcgtggagaactggctgaacaacaacacgcagttctgcatcaaggtgctgaacccctacatgccctccgtcatcgagaagatggaggccctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacccgcaacatcgggatcgagtccgagatccccaacctggacatcatcggcaagcggatcgagaagatcaagcaggagcacgagacgagctggcactacgaccaggaccacccctacaagacctgggcgtaccacggctcctacgagaccaagcagaccgggagcgcctccagcatggtcaacggcgtggtgcgcctgctcacgaagccgtgggacgtcctgcccaccgtgacccagatggccatgaccgacacgacccccttcgggcagcagcgcgtgttcaaggagaaggtcgacacccggacccaggagcccaaggagggcacgaagaagctgatgaagatcaccgccgagtggctctggaaggagctgggcaagaagaagaccccgcgcatgtgcacccgggaggagttcacgcgcaaggtgcggtccaacgccgcgctgggggccatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgcgatctggtacatgtggctgggcgcccggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgcggacgacaccgccgggtgggacacgcgcatcaccctcgaggacctgaagaacgaggagatggtgaccaaccacatggagggcgagcacaagaagctggccgaggccatcttcaagctcacctaccagaacaaggtcgtgcgggtgcagcgccccacgccccgggggaccgtcatggacatcatcagccgccgggaccagcgcggctccggccaggtgggcacctacggcctgaacaccttcacgaacatggaggcccagctgatccggcagatggagggggagggcgtgttcaagaacatccagcgcctcaccgtcaccgaggaggtggcggtgcacaactggctggcccgcgtcgggcgggagcgcctgagccggatggccatctccggcgacgactgcgtggtgaagcccctcgacgaccgcttcgccaacgccctgaccgcgctgaacgacatgggcaagatccggaaggacatccagcagtgggagccgagcaaggggtggaacgactggacgcaggtccccttctgctcccaccacttccacgagctcatcatgaaggacggccgcatcctggtggtgccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtcccctcccactgggtgccgaccagccgcaccacgtggtccatccacgccaagcacgagtggatgaccaccgaggacatgctgaccgtgtggaaccgggtctggatccgcgagaacccctggatggaggacaagacccccgtggagagctgggaggagatcccctacctcggcaagcgggaggaccagtggtgcgggtccctgatcggcctgacgagccgcgcgacctgggccaagaacatccaggccgccatcaaccaggtgcggtccctcatcgggaacgaggagtacaccgactacatgccgagcatgaagcgcttccgccgggaggaggaggaggcgggcgtcctgtggtga

SEQ ID NO: 9622 - RNA, 9876 nt, synthetic construct
  misc_feature 1..9876: note = derived and/or modified CDS sequence (opt1) from DENV-2__EU482542__SS-prME
  source 1..9876: mol_type = other RNA
agcgcggggatgatcatcatgctgatccccaccgtgatggccttccacctcaccacccggaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggccaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaaggtccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgcgatccagaaggcccaggaggaggggacgtgcggcatccgctccgtgacccggctggagaacctcatgtggaagcagatcacccccgagctgaaccacatcctggccgagaacgaggtgaagctcaccatcatgacgggggacatcaagggcatcatgcaggccgggaagcgcagcctgcggccgcagcccaccgagctgaagtactcctggaagacctggggcaaggccaagatgctcagcaccgagtcctacaaccagacgttcctgatcgacggccccgagaccgcggagtgcccgaacaccaaccgcgcctggaacagcctggaggtcgaggactacgggttcggcgtgttcaccacgaacatctggctcaagctgaaggagaagcaggacgccttctgcgactccaagctgatgagcgccgccatcaaggacaaccgggcggtgcacgccgacatggggtactggatcgagtccgccctcaacgacacctggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccacggtcatcgtgaccgaggactgcgggaaccggggcccctccctccgcaccaccacggccagcggcaagctgatcaccgagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgaagacgcgggtcgggaccaagcacgcgatcctcctggtggccgtgtccttcgtcaccctgatcaccggcaacatgagcttcaaggacctcgggcgcgtggtggtcatggtgggcgccacgatggccgacgacatcgggatgggcgtgacctacctggccctgctcgcggccttcaaggtccggcccaccttcgccgccggcctgctgctccgcaagctgacctccaaggagctgatgatgacgaccatcgggatcgtgctcctgagccagtccaccatccccgagaccgtgctggagctcacggacgccctggcgctgggcatgatggtcctcaagatcgtgcggaacatggagaagtaccagctggccgtcaccatcatggccatcctgtgcgtgccgaacgccgtgatcctccagaacgcctggaaggtcagctgcaccatcctggcggtggtgtccgtcagccccctgctcctgacctccagccagcagaagacggactggatccccctggccctcaccatcaaggggctgaaccccaccgccatcttcctgaccacgctctcccgcaccaacaagaagcgcagctggccgctgaacgaggccatcatggcggtgggcatggtgtccatcctggccagctccctcctgaagaacgacatccccatgaccggccccctggtcgccgggggcctcctgaccgtgtgctacgtgctgacggggcggagcgccgacctcgagctggagcgcgccaccgacgtcaagtgggaggaccaggcggagatctccggcagcagccccatcctgtccatcaccatcagcgaggacgggtccatgagcatcaagaacgaggaggaggagcagaccctcacgatcctgatccggaccggcctgctcgtgatctccggcctgttcccgatcagcatccccatcaccgccgccgcctggtacctgtgggaggtgaagaagcagcgcgccggggtcctctgggacgtgcccagcccgccgcccatgggcaaggcggagctggaggacggggcctaccggatcaagcagaagggcatcctggggtacagccagatcggcgccggcgtgtacaaggaggggaccttccacaccatgtggcacgtcacgcgcggcgccgtgctcatgcacaaggggaagcggatcgagccctcctgggccgacgtgaagaaggacctgatcagctacggcgggggctggaagctggagggcgagtggaaggagggggaggaggtccaggtgctcgcgctggagcccggcaagaacccccgcgccgtgcagaccaagcccgggctgttcaagaccaacaccggcacgatcggggccgtctccctcgacttcagccccggcacctccggcagccccatcatcgacaagaaggggaaggtggtgggcctgtacgggaacggcgtcgtgacccggtccggcgcctacgtgagcgccatcgcgcagaccgagaagtccatcgaggacaaccccgagatcgaggacgacatcttccgcaagcggcgcctgacgatcatggacctgcaccccggggccggcaagaccaagcggtacctccccgccatcgtccgcgaggccatcaagcgggggctgcgcaccctgatcctcgcgccgacccgggtggtggccgccgagatggaggaggccctgcgcggcctgcccatccggtaccagacgcccgccatccgcgcggagcacaccgggcgggagatcgtcgacctcatgtgccacgccaccttcaccatgcgcctgctgagccccgtgcgcgtgccgaactacaacctcatcatcatggacgaggcccacttcacggaccccgcctccatcgccgcgcggggctacatcagcacccgcgtcgagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgacggacttcaagggcaagaccgtgtggttcgtcccgagcatcaaggcggggaacgacatcgccgcctgcctgcgcaagaacggcaagaaggtgatccagctgtcccggaagaccttcgacagcgagtacgtgaagacccgcacgaacgactgggacttcgtcgtgaccaccgacatctccgagatgggcgccaacttcaaggcggagcgggtgatcgacccccgccggtgcatgaagcccgtcatcctcaccgacggggaggagcgcgtgatcctggccggccccatgccggtgacgcacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgggagaaggtcgacgccatcgacggcgagtaccgcctgcgcggggaggcccgcaagaccttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgacgctcaacctgatcaccgagatgggccgcctgcccaccttcatgacccagaagacgcgggacgccctcgacaacctggccgtgctgcacaccgccgaggccggcgggcgcgcctacaaccacgccctctccgagctgcccgagaccctggagaccctcctgctgctcacgctgctggccaccgtgaccgggggcatcttcctcttcctgatgagcggcaaggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacctacgtggtgatcgccatcctgaccgtcgtggccgcgaccatggccaacgagatgggcttcctggagaagacgaagaaggacctcgggctgggctccatcgccacccagcagccggagagcaacatcctggacatcgacctccgccccgcctccgcctggaccctgtacgcggtggccaccacgttcgtcacccccatgctgcggcacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcacgctcaccgccgccctgctgctcctggtcgcccactacgcgatcatcgggcccggcctgcaggccaaggccacccgcgaggcccagaagcgggccgcggccggcatcatgaagaaccccaccgtggacgggatcacggtgatcgacctcgacccgatcccctacgaccccaagttcgagaagcagctgggccaggtcatgctgctcatcctgtgcgtgacccaggtgctgatgatgcgcaccacctgggccctctgcgaggccctgacgctggccaccgggcccatctccaccctctgggagggcaacccggggcggttctggaacaccacgatcgcggtcagcatggccaacatcttccgcggctcctacctggccggcgccgggctcctcttcagcatcatgaagaacaccaccaacacccggcgcggcacggggaacatgggcgagaccctgggcgagaagtggaagtcccggctgaacgccctcggcaagagcgagttccagatctacaagaagtccggcatccaggaggtggaccgcaccctggcgaaggaggggatcaagcgcggcgagaccgaccaccacgccgtgagccgggggtccgccaagctgcgctggttcgtcgagcggaacatggtgacgcccgagggcaaggtggtcgacctcggctgcgggcgcggcgggtggagctactactgcggcgggctgaagaacgtgcgggaggtgaagggcctgaccaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgacggtcgaggccggccggaccctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacgtacgagcccgacgtcgacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcgtccagcatggtgaacggcgtggtccggctgctcaccaagccgtgggacgtgctgcccaccgtgacgcagatggccatgaccgacaccacccccttcgggcagcagcgcgtcttcaaggagaaggtggacacgcggacccaggagcccaaggagggcaccaagaagctgatgaagatcaccgccgagtggctctggaaggagctgggcaagaagaagacgccgcgcatgtgcacccgcgaggagttcacccggaaggtgcgctccaacgccgccctgggggcgatcttcaccgacgagaacaagtggaagtccgcccgggaggccgtcgaggactcccgcttctgggagctcgtggacaaggagcggaacctgcacctggagggcaagtgcgagacgtgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtgagcaagaaggagggcggcgccatgtacgccgacgacaccgcggggtgggacacccggatcaccctcgaggacctgaagaacgaggagatggtcacgaaccacatggagggcgagcacaagaagctggccgaggccatcttcaagctcacctaccagaacaaggtggtgcgcgtccagcggcccacgccccgggggaccgtgatggacatcatcagccggcgcgaccagcggggctccggccaggtggggacgtacggcctgaacaccttcaccaacatggaggcccagctgatccgccagatggagggggagggcgtcttcaagaacatccagcacctcaccgtgacggaggaggtggccgtccagaactggctggcgcgggtggggcgcgagcggctgagccgcatggccatctccggcgacgactgcgtggtcaagcccctcgacgaccgcttcgccaacgccctgaccgccctgaacgacatgggcaagatccggaaggacatccagcagtgggagccgagcaaggggtggaacgactggacccaggtgcccttctgctcccaccacttccacgagctcatcatgaaggacggccgcatcctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacacggactacatgccgagcatgaagcgcttccggcgcgaggaggaggaggccggcgtgctgtggtga

SEQ ID NO: 9623 - RNA, 9876 nt, synthetic construct
  misc_feature 1..9876: note = derived and/or modified CDS sequence (opt1) from DENV-2__JX966380__SS-prME
  source 1..9876: mol_type = other RNA
accgcgggcatgatcatcatgctgatccccaccgtgatggccttccacctcaccacccgcaacggggagccccacatgatcgtcagccggcaggagaagggcaagagcctgctgttcaagaccaaggacgggaccaacatgtgcaccctcatggcgatggacctgggcgagctgtgcgaggacaccatcacctacaagtgccccttcctcaagcagaacgagcccgaggacatcgactgctggtgcaacagcacctccacctgggtgacctacgggacctgcaccacgaccggcgagcaccgccgggagaagcgcagcgtggccctggtcccccacgtgggcatggggctggagacccggaccgagacgtggatgtccagcgagggcgcctggaagcacgcccagcgcatcgagacctggatcctccggcaccccgggttcaccatcatggccgcgatcctggcctacaccatcggcacgacccacttccagcgcgtgctgatcttcatcctcctgaccgccatcgccccctccatgaccatgcggtgcatcgggatcagcaaccgcgacttcgtcgagggcgtgtccggcgggagctgggtggacatcgtcctggagcacggctcctgcgtgacgaccatggcgaagaacaagcccaccctcgacttcgagctgatcaagaccgaggccaagcagcccgccacgctgcggaagtactgcatcgaggccaagctcaccaacaccaccacggacagccgctgcccgacccagggggagcccaccctgaacgaggagcaggacaagcggttcgtgtgcaagcactccatggtcgaccgcggctggggcaacgggtgcggcctgttcgggaagggcgggatcgtgacctgcgccatgttcacgtgcaagaagaacatggagggcaagatcgtgcagcccgagaacctcgagtacaccgtcgtgatcacgccccacagcggcgaggagcacgcggtggggaacgacaccggcaagcacgggaaggaggtcaagatcaccccgcagtccagcatcacggaggccgagctgaccggctacgggaccgtgaccatggagtgcagcccccggacgggcctggacttcaacgagatggtgctcctgcagatgaaggacaaggcctggctggtccaccgccagtggttcctcgacctgcccctgccctggctcccgggcgccgacacccaggggagcaactggatccagaaggagaccctggtgaccttcaagaacccccacgccaagaagcaggacgtggtcgtgctgggctcccaggagggggcgatgcacacggccctcaccggcgccaccgagatccagatgagcagcgggaacctgctgttcaccggccacctcaagtgccggctgcgcatggacaagctgcagctcaagggcatgtcctacagcatgtgcacggggaagttcaagatcgtcaaggagatcgccgagacccagcacggcaccatcgtgatccgggtgcagtacgagggggacggctccccctgcaagatccccttcgagatcatggacctggagaagcgccacgtcctgggccggctcatcaccgtgaacccgatcgtgacggagaaggacagccccgtcaacatcgaggccgagccgcccttcggggactcctacatcatcatcggcgtggagccggggcagctgaagctggactggttcaagaagggcagctccatcgggcagatgttcgagaccaccatgcgcggcgcgaagcgcatggccatcctcggcgacaccgcctgggacttcgggagcctgggcggggtgttcacgtccatcggcaaggccctgcaccaggtcttcggggccatctacggcgcggccttcagcggcgtgtcctggaccatgaagatcctcatcggggtgatcatcacctggatcggcatgaacagccggtccaccagcctgtccgtcagcctggtgctggtggggatcgtcacgctctacctgggcgtgatggtgcaggccgactccgggtgcgtcgtgagctggaagaacaaggagctgaagtgcggctccggcatcttcgtgaccgacaacgtccacacctggaccgagcagtacaagttccagcccgagagccccagcaagctcgcctccgcgatccagaaggcccacgaggaggggatctgcggcatccgcagcgtgacgcggctggagaacctgatgtggaagcagatcacctccgagctcaaccacatcctgagcgagaacgaggtgaagctgaccatcatgaccggggacatcaagggcatcatgcaggtcgggaagcgctccctccggccccagccgacggagctgcgctacagctggaagacctggggcaaggccaagaccctgtccaccgagctccacaaccagacgttcctgatcgacggccccgagaccgccgagtgccccaacaccaaccgggcctggaacagcctggaggtggaggactacgggttcggcgtgttcaccaccaacatctggctccgcctgcgggagaagcaggacgtcttctgcgactccaagctgatgagcgcggccatcaaggacaaccgcgccgtgcacgccgacatggggtactggatcgagtccgccctcaacgacacgtggaagatcgagaaggcgagcttcatcgaggtgaagtcctgccactggcccaagtcccacaccctgtggtccaacggcgtcctggagagcgagatggtgatccccaagaacttcgccggccccgtgtcccagcacaacaaccggcccgggtaccacacccagaccgccggcccgtggcacctcgggaagctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgccgcccctgcggtaccgcggggaggacggctgctggtacgggatggagatccggccgctcaaggagaaggaggagaacctggtcagctccctggtgacggccggccacgggcagatcgacaacttcagcctcggcatcctgggcatggcgctgttcctcgaggagatgctgcgcacccgggtggggaccaagcacgccatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgcgctgctggccgccttcaaggtgcggcccacgttcaccgccggcctcctgctgcgcaagctcacctccaaggagctgatgatgaccacgatcgggatcgtgctgctcagccagtccagcatccccgagaccatcctggagctgaccgacgccctcgcgctgggcatgatggtcctgaagatggtgcggaacatggagaagtaccagctcgccgtgaccatcatggccatcctgtgcgtccccaacgccgtgatcctgcagaacgcctggaaggtctcctgcacgatcctcgcggtggtgagcgtctccccgctgctgctcaccagctcccagcagaaggccgactggatccccctggccctgaccatcaaggggctcaaccccaccgccatcttcctgacgaccctgagccgcacctccaagaagcggagctggcccctcaacgaggccatcatggcggtgggcatggtgtccatcctggccagcagcctgctcaagaacgacatcccgatgaccggccccctggtcgccgggggcctgctcacggtgtgctacgtgctgaccgggcgctccgccgacctggagctcgagcgggcgaccgacgtcaagtgggacgaccaggccgagatcagcggctccagccccatcctgtccatcaccatcagcgaggacgggtccatgagcatcaagaacgaggaggaggagcagaccctgacgatcctcatccgcaccggcctgctggtgatctccggcctcttccccgtgagcatcccgatcaccgccgccgcctggtacctgtgggaggtcaagaagcagcgggcgggggtgctgtgggacgtgcccagcccgccgcccgtcggcaaggccgagctcgaggacggggcctaccgcatcaagcagaagggcatcctggggtacagccagatcggcgccggcgtgtacaaggaggggaccttccacacgatgtggcacgtgacccggggcgccgtcctgatgcacaaggggaagcgcatcgagccctcctgggcggacgtgaagaaggacctcatcagctacggcgggggctggaagctggagggcgagtggaaggagggggaggaggtgcaggtcctggccctcgagcccggcaagaacccccgggccgtgcagaccaagcccgggctgttccgcaccaacacgggcaccatcggggccgtgtccctggacttcagccccggcacctccggcagccccatcgtcgacaagaaggggaaggtggtgggcctctacgggaacggcgtcgtgacccggtccggcgcctacgtgagcgcgatcgcccagacggagaagtccatcgaggacaacccggagatcgaggacgacatcttccgcaagcggcgcctgaccatcatggacctgcaccccggggccggcaagaccaagcggtacctgcccgccatcgtccgcgaggccatcaagcgggggctccgcaccctgatcctggcgcccacgcgcgtggtggccgccgagatggaggaggccctccggggcctgccgatccgctaccagacccccgcgatccgggccgagcacaccgggcgcgagatcgtcgacctgatgtgccacgccaccttcacgatgcggctcctgagccccatccgcgtgcccaactacaacctgatcatcatggacgaggcccacttcaccgacccggccagcatcgcggcccggggctacatctccacccgcgtggagatgggcgaggccgccgggatcttcatgaccgccacgccgcccggcagccgggaccccttcccgcagtccaacgcgcccatcatggacgaggagcgcgagatccccgagcggagctggaactccgggcacgagtgggtcaccgacttcaagggcaagaccgtgtggttcgtgcccagcatcaagaccgggaacgacatcgccgcctgcctccgcaagaacggcaagcgggtcatccagctgtcccgcaagacgttcgacagcgagtacgtgaagacccggaccaacgactgggacttcgtggtcaccacggacatctccgagatgggcgccaacttcaaggccgagcgcgtgatcgacccgcggcgctgcatgaagcccgtgatcctgaccgacggggaggagcgggtcatcctcgcgggccccatgcccgtgacccacagctccgccgcccagcgccgcgggcggatcggccgcaacccgcggaacgagaacgaccagtacatctacatgggggagcccctggagaacgacgaggactgcgcccactggaaggaggcgaagatgctgctcgacaacatcaacacccccgagggcatcatccccagcatgttcgagccggagcgcgagaaggtggacgccatcgacggcgagtaccggctgcgcggggaggcccggaagacgttcgtcgacctgatgcgccggggcgacctccccgtgtggctggcctacaaggtggccgcggaggggatcaactacgccgaccgccggtggtgcttcgacggcacccgcaacaaccagatcctggaggagaacgtcgaggtggagatctggaccaaggagggggagcggaagaagctcaagccccgctggctggacgcccggatctactccgacccgctggccctcaaggagttcaaggagttcgccgcgggccgcaagagcctgaccctgaacctcatcacggagatgggccggctgcccaccttcatgacccagaaggcccgcgacgccctggacaacctcgccgtcctgcacaccgccgaggccgggggcaaggcctacaaccacgccctgtccgagctccccgagaccctggagacgctgctcctgctgaccctcctggccaccgtgaccgggggcatcttcctgttcctcatgagcggccgggggatcggcaagatgacgctggggatgtgctgcatcatcaccgcgtccatcctgctctggtacgcccagatccagccccactggatcgccgccagcatcatcctggagttcttcctgatcgtgctcctgatcccggagcccgagaagcagcgcacgccccaggacaaccagctgacctacgtcatcatcgccatcctcacggtggtggcggccaccatggccaacgagatgggcttcctggagaagaccaagaaggacctggggctcggcaacatcgccacccagcagcccgagagcaacatcctggacatcgacctgcggccggcctccgcgtggacgctctacgccgtcgccaccaccttcatcacccccatgctgcgccacagcatcgagaactccagcgtgaacgtgtccctgacggccatcgccaaccaggcgaccgtcctcatgggcctggggaagggctggcccctgagcaagatggacatcggggtgcccctcctggccatcggctgctactcccaggtgaacccgatcaccctgaccgccgccctcctgctgctcgtcgcccactacgcgatcatcgggcccggcctgcaggccaaggccacgcgcgaggcccagaagcgggcggccgccggcatcatgaagaaccccaccgtggacgggatcaccgtgatcgacctggaccccatcccgtacgaccccaagttcgagaagcagctcggccaggtcatgctgctggtgctctgcgtgacccaggtcctgatgatgcgcacgacctgggccctgtgcgaggccctcaccctggcgaccgggcccgtgagcacgctgtgggagggcaaccccgggcggttctggaacaccaccatcgccgtgtccatggccaacatcttccgcggcagctacctcgccggcgccgggctgctgttctccatcatgaagaacaccacgagcacccggcgcggcaccgggaacatcggcgagaccctcggcgagaagtggaagtcccggctgaacgcgctggggaagtccgagttccagatctacaagaagtccggcatccaggaggtcgaccgcacgctcgccaaggaggggatcaagcggggcgagaccgaccaccacgccgtgagccgcgggtccgccaagctgcggtggttcgtggagcgcaacctggtcaccccggagggcaaggtggtggacctcggctgcgggcggggcgggtggagctactactgcggcgggctgaagaacgtccgcgaggtgaagggcctgaccaagggcgggcccggccacgaggagcccatccccatgtccacctacgggtggaacctcgtgcggctgcagagcggcgtcgacgtgttcttcgtgccgcccgagaagtgcgacacgctgctctgcgacatcggggagagctcccccaaccccaccgtcgaggccggccgcaccctgcgggtgctgaacctcgtggagaactggctgaacaacaacacccagttctgcgtcaaggtgctgaacccgtacatgcccagcgtgatcgagcgcatggagacgctgcagcggaagtacggcggggcgctcgtccgcaaccccctgtcccgcaacagcacccacgagatgtactgggtgtccaacgccagcggcaacatcgtgtccagcgtcaacatgatctcccggatgctgatcaaccgcttcaccatgcggcacaagaaggccacctacgagccggacgtggacctcgggagcggcacgcgcaacatcgggatcgagtccgagacccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtgaacggcgtcgtgcgcctgctcaccaagccctgggacgtggtcccgatggtgacccagatggccatgacggacaccacccccttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcaccaagaaggtgcggtccaacgccgccctgggggcgatcttcaccgacgagaacaagtggaagtccgcccgcgaggccgtcgaggactcccggttctgggagctggtggacaaggagcgcaacctccacctggagggcaagtgcgagacctgcgtgtacaacatgatggggaagcgggagaagaagctgggcgagttcgggaaggccaagggcagccgcgccatctggtacatgtggctcggcgcgcggttcctggagttcgaggccctggggttcctcaacgaggaccactggttcagccgcgagaactccctgagcggcgtcgagggggagggcctgcacaagctcgggtacatcctgcgggaggtgtccaagaaggagggcggcgccatgtacgccgacgacacggccgggtgggacacccgcatcaccatcgaggacctgaagaacgaggagatgatcaccaaccacatggcgggcgagcacaagaagctcgccgaggccatcttcaagctgacgtaccagaacaaggtggtccgggtgcagcgcccgacgccccgcgggaccgtgatggacatcatcagccggcgcgaccagcggggctccgggcaggtcggcacctacggcctgaacaccttcaccaacatggaggcccagctcatccgccagatggagggggagggcatcttcaagaacatccagcacctgaccgcgagcgaggagatcgccgtgcaggactggctggtgcgggtcgggcgcgagcggctctcccgcatggccatcagcggcgacgactgcgtggtgaagcccctggacgaccggttcgcccgcgccctgaccgcgctcaacgacatgggcaaggtccggaaggacatccagcagtgggagccctcccgcgggtggaacgactggacccaggtgccgttctgcagccaccacttccacgagctgatcatgaaggacggccggacgctggtggtcccctgccgcaaccaggacgagctcatcgggcgggcccgcatctcccagggcgccgggtggagcctgcgggagaccgcctgcctgggcaagtcctacgcccagatgtggagcctcatgtacttccaccgccgggacctgcgcctggcggccaacgccatctgctccgccgtgcccagccactgggtgcccacctcccgcaccacgtggagcatccacgccagccacgagtggatgaccaccgaggacatgctcaccgtctggaacaaggtgtggatcctggagaacccgtggatggaggacaagacgcccgtggagtcctgggaggagatcccctacctgggcaagcgggaggaccagtggtgcgggagcctcatcggcctgacctcccgcgcgacctgggccaagaacatccagaccgccatcaaccaggtccggagcctgatcgggaacgaggagtacacggactacatgccctccatgaagcgcttccggcgcgaggaggaggaggccggcgtgctctggtga

SEQ ID NO: 9624 - RNA, 9876 nt, synthetic construct
  misc_feature 1..9876: note = derived and/or modified CDS sequence (opt1) from DENV-2__JX966379__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaagaccaaggacgggaccaacatgtgcaccctcatggcgatggacctgggcgagctgtgcgaggacaccatcacctacaagtgccccttcctcaagcagaacgagcccgaggacatcgactgctggtgcaacagcacctccacctgggtgacctacgggacctgcaccaccaccggcgagcaccggcggggcaagcggagcgtggccctggtcccccacgtggggatgggcctggagacccggaccgagacgtggatgtccagcgagggggcctggaagcacgcccagcgcatcgagacctggatcctccggcaccccggcttcaccatcatggccgcgatcctggcctacaccatcgggacgacccacttccagcgggtgctgatcttcatcctcctgaccgccatcgccccctccatgaccatgcggtgcatcggcatcagcaaccgcgacttcgtcgagggcgtgtccgggggcagctgggtggacatcgtcctggagcacgggtcctgcgtgacgaccatggcgaagaacaagcccaccctcgacttcgagctgatcaagaccgaggccaagcagcccgccagcctgcggaagtactgcatcgaggccaagctcacgaacaccaccaccgactcccgctgcccgacgcagggcgagcccaccctgaacgaggagcaggacaagcggttcgtgtgcaagcacagcatggtcgaccgcggctgggggaacggctgcgggctgttcggcaagggcgggatcgtgacctgcgccatgttcacgtgcaagaagaacatggagggcaagatcgtgcagcccgagaacctcgagtacacggtcgtgatcacgccccactccggggaggagcacgcggtgggcaacgacaccgggaagcacggcaaggaggtcaagatcaccccgcagagctccatcaccgaggccgagctgacggggtacggcaccgtgaccatggagtgcagcccccggaccggcctggacttcaacgagatggtgctcctgcagatggaggacaaggcctggctggtccaccgccagtggttcctcgacctgcccctgccctggctcccgggggccgacacgcagggctccaactggatccagaaggagaccctggtgaccttcaagaacccccacgccaagaagcaggacgtggtcgtgctggggagccaggagggcgcgatgcacaccgccctcacgggggccaccgagatccagatgagctccggcaacctgctgttcaccggccacctcaagtgccggctgcgcatggacaagctgcagctcaaggggatgagctactccatgtgcaccggcaagttcaagatcgtcaaggagatcgccgagacgcagcacgggaccatcgtgatccgggtgcagtacgagggcgacggcagcccctgcaagatccccttcgagatcatggacctggagaagcgccacgtcctggggcggctcatcaccgtgaacccgatcgtgaccgagaaggactcccccgtcaacatcgaggccgagccgcccttcggcgacagctacatcatcatcggggtggagccgggccagctgaagctggactggttcaagaaggggtccagcatcggccagatgttcgagacgaccatgcgcggcgcgaagcgcatggccatcctcggggacaccgcctgggacttcggctccctcggcggggtgttcaccagcatcgggaaggccctgcaccaggtcttcggggccatctacggcgcggccttctccggggtgagctggacgatgaagatcctcatcggcgtgatcatcacctggatcgggatgaactcccggagcacctccctgagcgtctccctggtgctggtgggcatcgtcaccctctacctgggggtgatggtgcaggccgacagcggctgcgtcgtgtcctggaagaacaaggagctgaagtgcggcagcgggatcttcgtgacggacaacgtccacacctggaccgagcagtacaagttccagcccgagagcccctccaagctcgccagcgcgatccagaaggcccacgaggagggcatctgcgggatccgctccgtgacccggctggagaacctgatgtggaagcagatcacgcccgagctcaaccacatcctgagcgagaacgaggtgaagctgaccatcatgaccggcgacatcaaggggatcatgcaggtcggcaagcgctccctccggccgcagcccaccgagctgcgctacagctggaagacgtggggcaaggccaagatgctgtccaccgagctccacaaccagaccttcctgatcgacgggcccgagaccgccgagtgcccgaacacgaaccgggcctggaacagcctggaggtggaggactacggcttcggggtgttcaccaccaacatctggctccgcctgcgggagaagcaggacgtcttctgcgactccaagctgatgagcgcggccatcaaggacaaccgcgccgtgcacgccgacatgggctactggatcgagtccgccctcaacgacacctggaagatcgagaaggcgagcttcatcgaggtgaagtcctgccactggcccaagagccacaccctgtggtccaacggcgtcctggagagcgagatggtgatccccaagaactacgccgggcccgtgtcccagcacaacaaccggccgggctaccacacgcagaccgccgggccctggcacctcggcaagctggagatggacttcgacttctgcgaggggaccaccgtcgtggtgacggaggagtgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtcagctccctggtgaccgccgggcacggccagatcgacaacttcagcctcggcatcctggggatggcgctgttcctcgaggagatgctgcgctcccgggtgggcaccaagcacgccatcctgctcgtcgccgtgagcttcgtgacgctgatcaccgggaacatgtccttccgcgacctgggccgcgtcatggtgatggtgggggccaccatgaccgacgacatcggcatgggcgtcacgtacctcgcgctgctggccgcctacaaggtgcggcccaccttcgccgccgggctcctgctgcgcaagctcaccagcaaggagctgatgatgaccacgatcggcatcgtgctgctctcccagagctccatccccgagaccatcctggagctgaccgacgcgctcgccctggggatgatggtcctgaagatggtgcggaacatggagaagtaccagctcgccgtgaccatcatggccatcctgtgcgtcccgaacgccgtgatcctgcagaacgcgtggaaggtcagctgcacgaccctcgccgtggtgtccgtcagccccctgctgctcacctccagccagcagaaggccgactggatccccctggccctgaccatcaagggcctcaaccccacggccatcttcctgaccaccctgtcccgcaccagcaagaagcggtcctggccgctcaacgaggcgatcatggccgtgggcatggtgagcatcctggccagctccctgctcaagaacgacatccccatgacggggcccctggtcgccggcgggctgctcaccgtgtgctacgtgctgaccggccgcagcgcggacctggagctcgagcgggccaccgacgtcaagtgggacgaccaggccgagatctccgggagctcccccatcctgagcatcacgatctccgaggacggcagcatgtccatcaagaacgaggaggaggagcagaccctgaccatcctcatccgcaccggcctgctggtgatcagcgggctgttcccggtgtccacccccatcacggccgccgcgtggtacctgtgggaggtcaagaagcagcgggccggcgtgctgtgggacgtgcccagcccgccgcccgtcgggaaggccgagctcgaggacggcgcctaccgcatcaagcagaaggggatcctgggctactcccagatcggcgccggggtgtacaaggagggcaccttccacaccatgtggcacgtgacccgcggggccgtcctgatgcacaagggcaagcgcatcgagcccagctgggccgacgtgaagaaggacctcatctcctacgggggcggctggaagctggagggggagtggaaggagggcgaggaggtgcaggtcctggccctcgagcccgggaagaacccccgggccgtgcagacgaagcccggcctgttccgcaccaacaccgggaccatcggcgccgtgagcctggacttctcccccggcacgagcgggtcccccatcgtcgacaagaagggcaaggtggtggggctctacggcaacggcgtcgtgacccggagcggggcgtacgtgagcgccatcgcccagaccgagaagtccatcgaggacaaccccgagatcgaggacgacatcttccgcaagcggcgcctgaccatcatggacctgcaccccggcgccgggaagacgaagcggtacctgcccgccatcgtccgcgaggcgatcaagcggggcctccgcaccctgatcctggccccgacccgcgtggtggccgccgagatggaggaggcgctccgggggctgcccatccgctaccagacccccgccatccgggccgagcacacgggccgcgagatcgtcgacctgatgtgccacgccaccttcaccatgcggctcctgagccccatccgcgtgccgaactacaacctgatcatcatggacgaggcccacttcaccgaccccgcgtccatcgccgcccggggctacatcagcacgcgcgtggagatgggggaggccgccggcatcttcatgaccgcgacgccgcccgggtcccgggacccgttcccccagagcaacgcccccatcatggacgaggagcgcgagatccccgagcggtcctggaacagcggccacgagtgggtcaccgacttcaaggggaagacggtgtggttcgtgccgtccatcaaggccggcaacgacatcgcgacctgcctccgcaagaacggcaagcgggtcatccagctgagccgcaagaccttcgactccgagtacgtgaagacccggacgaacgactgggacttcgtggtcaccaccgacatcagcgagatgggggccaacttcaaggcggagcgcgtgatcgacccccggcgctgcatgaagcccgtgatcctgaccgacggcgaggagcgggtcatcctcgccgggcccatgccggtgacgcactccagcgccgcccagcgccgcggccggatcgggcgcaacccccggaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgcgagaaggtggacgccatcgacggggagtaccggctgcgcggcgaggcccggaagaccttcgtcgacctgatgcgccgcggggacctccccgtgtggctggcctacaaggtggcgagcgagggcatcaactacgccgaccgccggtggtgcttcgacgggacccgcaacaaccagatcctggaggagaacgtcgaggtggagatctggacgaaggagggcgagcggaagaagctcaagccgcgctggctggacgcccggatctactccgaccccctggccctcaaggagttcaaggagttcgccgcgggccgcaagagcctgaccctgaacctcatcaccgagatggggcggctgcccaccttcatgacgcagaaggcccgcgacgccctggacaacctcgccgtcctgcacaccgccgaggcgggcgggaaggcctacaaccacgccctgtccgagctccccgagaccctggagaccctgctcctgctgaccctcctggccacggtgaccggcggcatcttcctgttcctcatgagcgggcggggcatcgggaagatgaccctgggcatgtgctgcatcatcaccgcgagcatcctgctctggtacgcccagatccagccgcactggatcgccgcctccatcatcctggagttcttcctgatcgtgctcctgatccccgagcccgagaagcagcgcacgccccaggacaaccagctgacctacgtcatcatcgccatcctcaccgtggtggcggccaccatggccaacgagatggggttcctggagaagacgaagaaggacctgggcctcggccacatcgccacccagcagccggagagcaacatcctggacatcgacctgcggcccgcctccgcgtggaccctctacgccgtcgccaccacgttcatcacccccatgctgcgccacagcatcgagaactccagcgtgaacgtgtccctgaccgccatcgccaaccaggcgaccgtcctcatggggctgggcaaggggtggcccctgagcaagatggacatcggcgtgccgctcctggccatcgggtgctactcccaggtgaaccccatcacgctgaccgccgccctcctgctgctcgtcgcccactacgcgatcatcggccccggcctgcaggccaaggccacccgcgaggcccagaagcgggcggccgccgggatcatgaagaaccccaccgtggacggcatcacggtgatcgacctggacccgatcccctacgaccccaagttcgagaagcagctcgggcaggtcatgctgctggtgctctgcgtgacccaggtcctgatgatgcgcaccacctgggccctgtgcgaggccctcacgctggcgaccggccccgtgagcaccctgtgggaggggaacccgggccggttctggaacaccacgatcgccgtgtccatggccaacatcttccgcggcagctacctcgccggggccggcctgctgttctccatcatgaagaacaccaccagcacccggcgcgggacgggcaacatcggcgagaccctcggggagaagtggaagtcccggctgaacgcgctgggcaagagcgagttccagatctacaagaagtccgggatccaggaggtcgaccgcaccctcgccaaggagggcatcaagcgcggggagaccgaccaccacgccgtgagccgcggctccgccaagctgcggtggttcgtggagcgcaacctggtcacgcccgagggcaaggtggtggacctcgggtgcggccgcgggggctggagctactactgcgggggcctgaagaacgtccgcgaggtgaagggcctgaccaagggcggccccgggcacgaggagcccatcccgatgagcacctacggctggaacctcgtgcggctgcagtccggggtcgacgtgttcttcgtgccgcccgagaagtgcgacaccctgctctgcgacatcggcgagagctcccccaacccgaccgtcgaggccggccgcacgctgcgggtgctgaacctcgtggagaactggctgaacgacaacacccagttctgcgtcaaggtgctgaacccctacatgcccagcgtgatcgagcgcatggagaccctgcagcggaagtacgggggcgcgctcgtccgcaacccgctgtcccgcaacagcacccacgagatgtactgggtgtccaacgccagcgggaacgtggtctccagcgtgaacatgatctcccggatgctgatcaaccgcttcacgatgcggcacaagaaggccacctacgagcccgacgtggacctcggcagcgggacccgcaacatcggcatcgagtccgagacccccaacctggacatcatcggcaagcggatcgagaagatcaagcaggagcacgaggccagctggcactacgaccaggaccacccctacaagacgtgggcgtaccacgggtcctacgagaccaagcagaccggcagcgcctccagcatggtcaacggggtggtgcgcctgctcaccaagccgtgggacgtcgtgcccatggtgacgcagatggccatgaccgacaccacccccttcggccagcagcgggtcttcaaggagaaggtggacacgcgcacccaggagcccaaggagggcaccaagaagctgatgaagatcaccgccgagtggctgtggaaggagctcgggaagaagaagacgccgcggatgtgcacccgcgaggagttcaccaagaaggtccggtccaacgccgcgctgggcgccatcttcaccgacgagaacaagtggaagtccgcccgcgaggccgtggaggacaaccggttctgggagctggtggacaaggagcgcaacctccacctggaggggaagtgcgagacgtgcgtctacaacatgatgggcaagcgggagaagaagctgggggagttcggcaaggcccgcggcagccgggcgatctggtacatgtggctcggggcccgcttcctggagttcgaggccctgggcttcctcaacgaggaccactggttctcccgggagaacagcctgtccggggtggagggcgaggggctgcacaagctcggctacatcctgcgcgaggtgagcaagaaggagggcggggccatgtacgccgacgacaccgcgggctgggacacccggatcaccatcgaggacctgaagaacgaggagatgatcacgaaccacatggccggggagcacaagaagctcgccgaggccatcttcaagctgacctaccagaacaaggtcgtgcgcgtgcagcgccccacgccccggggcaccgtcatggacatcatctcccgccgggaccagcgcgggagcggccaggtggtgacgtacggcctgaacaccttcaccaacatggaggcgcagctcatccggcagatggagggggagggcatcttcaagtccatccagcacctgaccgccagcgaggagatcgccgtccaggactggctggcccgcgtggggcgggagcgcctctcccggatggccatcagcggcgacgactgcgtggtcaagcccctggacgaccgcttcgcgcgggccctgacggccctcaacgacatgggcaaggtgcgcaaggacatccagcagtgggagccgtcccgggggtggaacgactggacccaggtgcccttctgcagccaccacttccacgagctgatcatgaaggacggccgcaccctggtcgtgccctgccggaaccaggacgagctcatcgggcgcgcccggatctcccagggcgccgggtggagcctgcgcgagaccgcgtgcctgggcaagtcctacgcccagatgtggagcctcatgtacttccaccggcgcgacctgcgcctggccgccaacgccatctgctccgcggtgcccagccactgggtcccgaccagccggacgacctggtccatccacgccagccacgagtggatgaccaccgaggacatgctcacggtgtggaaccgcgtgtggatcctggagaacccctggatggaggacaagacccccgtcgagtcctgggaggagatcccctacctgggcaagcgggaggaccagtggtgcgggagcctcatcggcctgacctcccgcgccacctgggccaagaacatccagacggccatcaaccaggtgcggagcctgatcgggaacgaggagtacaccgactacatgccgtccatgaagcgcttccggcgcgaggaggaggaggcgggcgtgctctggtga

SEQ ID NO: 9625 - RNA, 9876 nt, synthetic construct
  misc_feature 1..9876: note = derived and/or modified CDS sequence (opt1) from DENV-2__KP012546__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggccctgttcctcgaggagatgctgcgcacccgggtggggaccaagcacgcgatcctgctcgtcgccgtgtccttcgtgaccctgatcacgggcaacatgagcttccgcgacctggggcgcgtcatggtgatggtgggcgccgccatgaccgacgacatcgggatgggcgtcacctacctcgccctgctggcggccttcaaggtgcggcccaccttcgccgccggcctcctgctgcgcaagctcacgtccaaggagctgatgatgaccaccatcgggatcgtgctgctcagccagtccaccatgcccgagacgatcctggagctgaccgacgccctcgcgctgggcatgatggtcctgaagatcgtgcggaacatggagaagtaccagctcgccgtcaccatcatggccatcctgtgcgtgccgaacgccgtgatcctgcagaacgcctggaaggtcagctgcaccacgctcgcggtggtgtccgtcagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtgagcatcctggcctccagcctgctcaagaacgacatccccatgaccggccccctggtcgccgggggcctgctcacggtgtgctacgtgctgaccgggcgcagcgccgacctggagctcgagcgggcggccgacgtccgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtgtccatccccatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgccggcgtgtacaaggaggggaccttccacaccatgtggcacgtgacgcgcggcgcggtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggccgtgagcctggacttctcccccggcaccagcggctcccccatcgtcgacaagaaggggaaggtggtgggcctctacgggaacggcgtcgtgacccggagcggcacctacgtgtccgcgatcgcccagacggagaagtccatcgaggacaaccccgagatcgaggacgacatcttccgcaagaagcggctgaccatcatggacctgcaccccggggccggcaagaccaagcgctacctgcccgccatcgtccgggaggcgatcaagcgcgggctccggaccctgatcctggccccgacgcgcgtggtggccgccgagatggaggaggccctccgcggcctgcccatccggtaccagacccccgcgatccgcgccgagcacaccgggcgggagatcgtcgacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtcaccgacttcaagggcaagaccgtgtggttcgtgccgtccatcaaggccgggaacgacatcgccgcctgcctccggaagaacggcaagaaggtcatccagctgagccgcaagaccttcgactccgagtacatcaagacgcggaccaacgactgggacttcgtggtgaccaccgacatcagcgagatgggcgcgaacttcaaggccgagcgcgtcatcgacccccggcgctgcatgaagcccgtgatcctgacggacggggaggagcgggtgatcctcgccggccccatgccggtcacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatctccacccccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcctaccgggtcgcggccgaggggatcaactacgccgaccgccggtggtgcttcgacggcgtgaagaacaaccagatcctggaggagaacgtggaggtcgagatctggacgaaggagggggagcgcaagaagctcaagccgcggtggctggacgcccgcatctactccgaccccctggccctcaaggagttcaaggagttcgcggccggccgcaagagcctgaccctgaacctcatcaccgagatgggccgcctgcccaccttcatgacgcagaaggcccggaacgccctggacaacctcgcggtgctgcacaccgccgaggccgggggccgcgcctacaaccacgccctgtccgagctccccgagaccctggagaccctgctcctgctgacgctcctggcggccgtgaccgggggcatcttcctgttcctcatgagcggcaaggggatcggcaagatgaccctggggatgtgctgcatcatcaccgcctccatcctgctctggtacgcccagatccagccgcactggatcgccgcgagcatcatcctggagttcttcctgatcgtcctcctgatccccgagcccgagaagcagcggacgccccaggacaaccagctgacgtacgtggtgatcgccatcctcaccgtcgtggccgccaccatggccaacgagatgggcttcctggagaagaccaagaaggacttcgggctgggcagcacgaccacccagcagccggagtccaacatcctcgacatcgacctgcgccccgcgagcgcctggaccctgtacgccgtggccacgaccttcatcacccccatgctccggcactccatcgagaacagctccgtcaacgtgagcctgaccgccatcgcgaaccaggccacggtgctgatgggcctcgggaagggctggcccctgtccaagatggacatcggggtcccgctgctcgccatcggctgctacagccaggtgaaccccatcaccctgaccgccgcgctgctcctgctggtggcccactacgccatcatcgggcccggcctccaggccaaggccacccgcgaggcgcagaagcgggccgccgccggcatcatgaagaaccccacggtcgacgggatcaccgtgatcgacctggacccgatcccctacgaccccaagttcgagaagcagctgggccaggtgatgctcctggtcctgtgcgtgacccaggtgctcatgatgcgcaccacgtgggccctgtgcgaggcgctgaccctcgccaccgggcccatctccaccctgtgggagggcaacccggggcgcttctggaacacgaccatcgccgtcagcatggccaacatcttccggggctcctacctggccggcgcggggctcctgttcagcatcatgaagaacaccgccaacacccgccggggcacggggaacaccggcgagaccctgggcgagaagtggaagaaccgcctcaacgccctggggaagtccgagttccagatctacaagaagtccggcatccaggaggtggaccggaccctggccaaggaggggatcaagcgcggcgagacggaccaccacgcggtgtcccgggggagcgccaagctccgctggttcgtcgagcggaacctggtgacccccgagggcaaggtggtcgacctgggctgcgggcgcggcgggtggtcctactactgcggcgggctcaagaacgtgaaggaggtgaagggcctgaccaagggcgggcccggccacgaggagcccatcccgatgagcacctacgggtggaacctggtccggctccagtccggcgtggacgtgttcttcacgccgcccgagaagtgcgacaccctgctgtgcgacatcggggagagcagccccaacccgaccgtcgaggccggccgcaccctccgggtgctgaacctggtggagaactggctcaacaacaacacccagttctgcatcaaggtcctgaacccctacatgccctccgtgatcgagaagatggaggccctgcagcgcaagtacggcggggccctggtgcggaacccgctcagccgcaactccacgcacgagatgtactgggtcagcaacgcgtccggcaacatcgtgagctccgtgaacatgatcagccggatgctgatcaaccgcttcaccatgcggcacaagaaggccacctacgagcccgacgtcgacctggggtccggcacccgcaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctgctgaccaagccgtgggacgtgatccccatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagaccccgcgcatgtgcacccgggaggagttcacgcgcaaggtccggagcaacgccgccctcggggccatcttcaccgacgagaacaagtggaagtccgcccgcgaggcggtggaggacagcggcttctgggagctggtggacaaggagcggaacctgcacctcgaggggaagtgcgagacctgcgtctacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaacagcctctccggggtggagggcgaggggctgcacaagctgggctacatcctccgcgacgtgagcaagaaggagggcggggccatgtacgccgacgacaccgccggctgggacacgcggatcaccctggaggacctgaagaacgaggagatggtcaccaaccacatggagggggagcacaagaagctcgccgaggcgatcttcaagctgacctaccagaacaaggtggtgcgcgtccagcggcccacgccccgcggcaccgtgatggacatcatctcccggcgcgaccagcgggggagcggccaggtggtcacctacggcctgaacaccttcacgaacatggaggcccagctcatccgccagatggagggggagggcgtgttcaagtccatccagcagctgaccgtgaccgaggagatcgccgtcaagaactggctggtgcgcgtggggcgggagcgcctcagccggatggccatctccggcgacgactgcgtcgtgaagcccctggacgaccgcttcgccagcgcgctgaccgccctcaacgacatgggcaaggtgcggaaggacatccagcagtgggagccgtcccgcgggtggaacgactggacgcaggtccccttctgcagccaccacttccacgagctgatcatgaaggacggccgggtgctggtggtcccctgccgcaaccaggacgagctcatcgggcgggcccgcatctcccagggcgccgggtggagcctgcgggagaccgcctgcctgggcaagtcctacgcgcagatgtggaacctcatgtacttccaccgccgggacctgcgcctggccgccaacgccatctgcagcgccgtgccctcccactgggtgccgaccagccggaccacctggtccatccacgcgacgcacgagtggatgaccaccgaggacatgctcaccgtctggaaccgcgtgtggatccaggagaacccctggatggaggacaagacgcccgtggagagctgggaggagatcccctacctgggcaagcgggaggaccagtggtgcgggagcctgatcggcctcacctcccgcgccacctgggccaagaacatccagaccgccatcaaccaggtccggagcctgatcgggaacgaggagtacacggactacatgccgtccatgaagcgcttccgccgggaggaggaggaggcgggcgtgctgtggtga

SEQ ID NO: 9626 - RNA, 9876 nt, synthetic construct
  misc_feature 1..9876: note = derived and/or modified CDS sequence (opt1) from DENV-2__KP723478__SS-prME
  source 1..9876: mol_type = other RNA
accgccggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccatgagccagcacaactaccgcccggggtaccacacccagaccgcgggcccctggcacctcgggcggctggagatggacttcgacttctgcgagggcacgaccgtggtggtcaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgacggccggccacgggcagatcgacaacttcagcctcggcgtcctgggcatggccctgttcctcgaggagatgctgcgcacccgggtggggaccaagcacgcgatcctgctcgtggccgtctccttcgtgaccctgatcacgggcaacatgagcttccgcgacctggggcgcgtgatggtcatggtgggcgccgccatgaccgacgacatcgggatgggcgtgacctacctcgccctgctggcggccttcaaggtccggcccaccttcgccgccggcctcctgctgcgcaagctcacgtccaaggagctgatgatgaccaccatcgggatcgtgctgctcagccagtccaccatgcccgagacgatcctggagctgaccgacgccctcgcgctgggcatgatggtgctgaagatcgtccggaacatggagaagtaccagctcgccgtgaccatcatggccatcctgtgcgtcccgaacgccgtgatcctgcagaacgcctggaaggtgagctgcaccacgctcgcggtcgtgtccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtcggcatggtgagcatcctggcctccagcctgctcaagaacgacatccccatgaccggccccctggtggccgggggcctgctcacggtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtcatcagcggcctcttcccggtgtccacccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacacgatgtggcacgtgacccgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacacgggcaccatcggggccgtgagcctggacttctcccccggcaccagcggctcccccatcgtggacaagaaggggaaggtcgtgggcctctacgggaacggcgtggtcacccggagcggcacgtacgtgtccgcgatcgcccagaccgagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggacgctgatcctggccccgacccgcgtcgtggccgccgagatggaggaggccctccgcggcctgcccatccggtaccagacccccgcgatccgcgccgagcacaccgggcgggagatcgtggacctgatgtgccacgccacgttcaccatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctccggaagaacggcaagaaggtgatccagctgagccgcaagacgttcgactccgagtacatcaagacccggaccaacgactgggacttcgtcgtgaccacggacatcagcgagatgggcgcgaacttcaaggccgagcgcgtgatcgacccccggcgctgcatgaagcccgtcatcctgaccgacggggaggagcgggtgatcctcgccggccccatgccggtgacccactccagcgccgcccagcgccgggggcgcgtcggccgcaaccccaagaacgagaacgaccagtacatctacatgggggagcccctggagaacgacgaggactgcgcgcactggaaggaggccaagatgctgctcgacaacatctccacccccgagggcatcatcccgagcatgttcgagcccgagcgggagaaggtggacgccatcgacggcgagtaccgcctgcgcggggaggcccgcaagacgttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctactccgaccccctggccctcaaggagttcaaggagttcgcggccggccgcaagagcctgaccctgaacctcatcaccgagatgggccgcctgcccacgttcatgacccagaaggcccggaacgccctggacaacctcgcggtcctgcacaccgccgaggccgggggccgcgcctacaaccacgccctgtccgagctccccgagaccctggagacgctgctcctgctgaccctcctggcggccgtgaccgggggcatcttcctgttcctcatgagcggcaaggggatcggcaagatgaccctggggatgtgctgcatcatcaccgcctccatcctgctctggtacgcccagatccagccgcactggatcgccgcgagcatcatcctggagttcttcctgatcgtgctcctgatccccgagcccgagaagcagcggacgccccaggacaaccagctgacctacgtcgtgatcgccatcctcaccgtggtcgccgccaccatggccaacgagatgggcttcctggagaagacgaagaaggacttcgggctgggcagcaccaccacccagcagccggagtccaacatcctcgacatcgacctgcgccccgcgagcgcctggacgctgtacgccgtggccaccaccttcatcacccccatgctccggcactccatcgagaacagctccgtgaacgtcagcctgacggccatcgcgaaccaggccaccgtgctgatgggcctcgggaagggctggcccctgtccaagatggacatcggggtgccgctgctcgccatcggctgctacagccaggtcaaccccatcaccctgaccgccgcgctgctcctgctggtggcccactacgccatcatcgggcccggcctccaggccaaggccacgcgcgaggcgcagaagcgggccgccgccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcgcacgacctgggccctgtgcgaggcgctgaccctcgccaccgggcccatctccacgctgtgggagggcaacccggggcgcttctggaacaccaccatcgccgtgagcatggccaacatcttccggggctcctacctggccggcgcggggctcctgttcagcatcatgaagaacaccgccaacacgcgccggggcaccgggaacaccggcgagaccctgggcgagaagtggaagaaccgcctcaacgccctggggaagtccgagttccagatctacaagaagtccggcatccaggaggtcgaccggacgctggccaaggaggggatcaagcgcggcgagaccgaccaccacgcggtgtcccgggggagcgccaagctccgctggttcgtggagcggaacctggtcacccccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacgtacgggtggaacctggtgcggctccagtccggcgtcgacgtgttcttcacgccgcccgagaagtgcgacaccctgctgtgcgacatcggggagagcagccccaacccgaccgtggaggccggccgcaccctccgggtcctgaacctggtggagaactggctcaacaacaacacgcagttctgcatcaaggtgctgaacccctacatgccctccgtcatcgagaagatggaggccctgcagcgcaagtacggcggggccctggtgcggaacccgctcagccgcaactccacccacgagatgtactgggtgagcaacgcgtccggcaacatcgtcagctccgtgaacatgatcagccggatgctgatcaaccgcttcaccatgcggcacaagaaggccacctacgagcccgacgtggacctggggtccggcacgcgcaacatcgggatcgagagcgagacccccaacctcgacatcatcggcaagcgcatcgagaagatcaagcaggagcacgagacctcctggcactacgaccaggaccacccctacaagacctgggcctaccacggcagctacgagacgaagcagaccgggtccgccagctccatggtcaacggcgtggtgcggctgctgaccaagccgtgggacgtcatccccatggtgacccagatggccatgacggacaccacccccttcgggcagcagcgcgtgttcaaggagaaggtcgacacccggacgcaggagcccaaggagggcaccaagaagctcatgaagatcaccgcggagtggctgtggaaggagctgggcaagaagaagaccccgcgcatgtgcacgcgggaggagttcacccgcaaggtgcggagcaacgccgccctcggggccatcttcaccgacgagaacaagtggaagtccgcccgcgaggcggtcgaggacagcggcttctgggagctggtggacaaggagcggaacctgcacctcgaggggaagtgcgagacctgcgtgtacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaacagcctctccggggtcgagggcgaggggctgcacaagctgggctacatcctccgcgacgtgagcaagaaggagggcggggccatgtacgccgacgacacggccggctgggacacccggatcaccctggaggacctgaagaacgaggagatggtgaccaaccacatggagggggagcacaagaagctcgccgaggcgatcttcaagctgacgtaccagaacaaggtcgtgcgcgtgcagcggcccacgccccggggcaccgtcatggacatcatctcccggcgcgaccagcgggggagcggccaggtggtgacctacggcctgaacacgttcaccaacatggaggcccagctcatccgccagatggagggggagggcgtcttcaagtccatccagcagctgaccgtgaccgaggagatcgccgtgaagaactggctggtccgcgtggggcgggagcgcctcagccggatggccatctccggcgacgactgcgtggtcaagcccctggacgaccgcttcgccagcgcgctgacggccctcaacgacatgggcaaggtgcggaaggacatccagcagtgggagccgtcccgcgggtggaacgactggacccaggtgcccttctgcagccaccacttccacgagctgatcatgaaggacggccgggtcctggtggtgccctgccgcaaccaggacgagctcatcgggcgggcccgcatctcccagggcgccgggtggagcctgcgggagaccgcctgcctgggcaagtcctacgcgcagatgtggaacctcatgtacttccaccgccgggacctgcgcctggccgccaacgccatctgcagcgccgtcccctcccactgggtgccgaccagccggaccacgtggtccatccacgcgacccacgagtggatgaccaccgaggacatgctcacggtgtggaaccgcgtctggatccaggagaacccctggatggaggacaagacccccgtggagagctgggaggagatcccctacctgggcaagcgggaggaccagtggtgcgggagcctgatcggcctcacctcccgcgccacctgggccaagaacatccagacggccatcaaccaggtgcggagcctgatcgggaacgaggagtacaccgactacatgccgtccatgaagcgcttccgccgggaggaggaggaggcgggcgtcctgtggtga

SEQ ID NO: 9627 - RNA, 9876 nt, synthetic construct
  misc_feature 1..9876: note = derived and/or modified CDS sequence (opt1) from DENV-2__KP723479__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccacccggggttcaccatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagatgaaggagcgccaggacgtcttctgcgacagcaagctgatgtccgccgcgatcaaggacagccgggccgtgcacgccgacatggggtactggatcgagtccgccctgaacgacacgtggaagatcgagaaggccagcttcatcgaggtgaagtcctgccactggcccaagagccacaccctctggtccaacggcgtcctggagagcgagatgatcatccccaagaacttcgcgggccccgtgagccagcacaactaccgcccggggtaccacacccagaccgccggcccctggcacctggggcggctcgagatggacttcgacttctgcgagggcaccacggtggtcgtgaccgaggactgcgggaaccgcggcccctccctgcggaccaccacggccagcggcaagctgatcaccgagtggtgctgccgctcctgcaccctgccgcccctgcggtaccgcggggaggacggctgctggtacgggatggagatccggcccctgaaggagaaggaggagaacctcgtgaacagcctggtcaccgccggccacgggcagatcgacaacttctccctgggcgtgctcggcatggcgctgttcctggaggagatgctccgcacgcgggtggggaccaagcacgccatcctgctggtcgccgtgagcttcgtgaccctcatcaccggcaacatgtccttccgcgacctggggcgcgtcatggtgatggtgggcgccacgatgaccgacgacatcgggatgggcgtcacctacctggccctcctggcggccttcaaggtgcggcccaccttcgccgccggcctgctcctgcgcaagctgacgagcaaggagctcatgatgaccaccatcgggatcgtgctgctgtcccaggccaccatccccgagacgatcctcgagctgaccgacgcgctggccctcggcatgatggtcctgaagatcgtgcggaacatggagaagtaccagctggccgtcaccatcatggccatcctctgcgtgcccaacgccgtgatcctgcagaacgcgtggaaggtcagctgcaccacgctggccgtggtgtccgtcagccccctcctgctgacctccagccagcagaaggccgactggatccccctcgccctgaccatcaaggggctgaaccccaccgcgatcttcctcacgaccctgtcccgcaccaacaagaagcggagctggccgctgaacgaggccatcatggccgtgggcatggtgtccatcctcgccagctccctgctgaagaacgacatccccatgaccggccccctcgtcgccgggggcctgctgacggtgtgctacgtgctcaccgggcgcagcgcggacctggagctggagcgggccgccgacgtccgctgggaggagcaggccgagatcagcggctccagccccatcctctccatcaccatcagcgaggacgggtccatgagcatcaagaacgaggaggaggagcagaccctgacgatcctgatccggaccggcctcctggtggtgtccggcctgttcccggtcagcacccccatcaccgccgcggcctggtacctctgggaggtgaagaagcagcgcgccggggtgctgtgggacgtccccagcccgccgcccgtgggcaaggccgagctggaggacggggcctaccggatcaagcagaagggcatcctcgggtacagccagatcggcgcgggcgtgtacaaggaggggaccttccacacgatgtggcacgtcacccgcggcgccgtgctgatgcacaaggggaagcggatcgagccctcctgggccgacgtgaagaaggacctgatcagctacggcgggggctggaagctcgagggcgagtggaaggagggggaggaggtccaggtgctggccctggagcccggcaagaacccccgcgccgtgcagaccaagcccggcctcttcaagaccaacacgggcaccatcggggcggtctccctggacttcagccccggcacctccggcagccccatcgtggacaagaaggggaaggtggtcggcctgtacgggaacggcgtggtgacccggtccggcacgtacgtcagcgccatcgcccagaccgagaagtccatcgaggacaaccccgagatcgaggacgacatcttccgcaagaagcggctcaccatcatggacctgcaccccggggccggcaagaccaagcgctacctgcccgcgatcgtgcgggaggccatcaagcgcgggctgcggacgctcatcctggccccgacccgcgtggtcgccgccgagatggaggaggcgctgcgcggcctccccatccggtaccagacccccgccatccgcgccgagcacaccgggcgggagatcgtggacctgatgtgccacgccacgttcaccatgcgcctgctcagccccatccgggtgccgaactacaacctgatcatcatggacgaggcccacttcaccgaccccgcgagcatcgccgcccgcggctacatctccacccgggtcgagatgggcgaggccgccgggatcttcatgacggcgacgccgcccggcagccgcgacccgttcccccagtccaacgcccccatcatggacgaggagcgggagatccccgagcgcagctggaactccgggcacgagtgggtgaccgacttcaagggcaagaccgtgtggttcgtcccgagcatcaaggccgggaacgacatcgccgcgtgcctgcggaagaacggcaagaaggtgatccagctctcccgcaagacgttcgacagcgagtacatcaagacccggaccaacgactgggacttcgtggtcaccacggacatctccgagatgggcgccaacttcaaggccgagcgcgtgatcgacccccggcgctgcatgaagcccgtgatcctgaccgacggggaggagcgggtcatcctggccggccccatgccggtgacccacagctccgccgcgcagcgccgggggcgcgtgggccgcaaccccaagaacgagaacgaccagtacatctacatgggggagcccctcgagaacgacgaggactgcgcccactggaaggaggccaagatgctgctggacaacatcaacacccccgagggcatcatcccgagcatgttcgagcccgagcgggagaaggtcgacgccatcgacggcgagtaccgcctccgcggggaggcccgcaagacgttcgtggacctgatgcggcgcggcgacctgcccgtctggctcgcgtaccgggtggccgccgaggggatcaactacgccgaccgccggtggtgcttcgacggcgtgaagaacaaccagatcctggaggagaacgtcgaggtggagatctggaccaaggagggggagcgcaagaagctgaagccgcggtggctcgacgcccgcatctactccgaccccctggcgctgaaggagttcaaggagttcgccgccggccgcaagagcctcaccctgaacctgatcaccgagatgggccggctccccacgttcatgacccagaaggcccggaacgcgctggacaacctggccgtgctccacaccgccgaggccgggggccgcgcctacaaccacgcgctgtccgagctgcccgagaccctcgagacgctgctgctcctgaccctgctcgccaccgtcaccgggggcatcttcctgttcctgatgagcggcaaggggatcggcaagatgaccctcgggatgtgctgcatcatcacggcctccatcctgctgtggtacgcccagatccagccgcactggatcgccgcgagcatcatcctcgagttcttcctgatcgtgctgctcatccccgagcccgagaagcagcggacgccccaggacaaccagctgacctacgtggtcatcgccatcctgaccgtggtggccgccacgatggccaacgagatgggcttcctcgagaagaccaagaaggacttcgggctgggctccatcaccacccagcagccggagaacaacatcctggacatcgacctccgccccgcgagcgcctggacgctgtacgccgtcgccaccaccttcatcacccccatgctgcggcacagcatcgagaactccagcgtgaacgtgtccctcacggccatcgcgaaccaggccaccgtcctgatgggcctggggaagggctggcccctcagcaagatggacatcggggtgccgctgctggccatcggctgctactcccaggtgaaccccatcaccctcaccgccgcgctgctgctcctggtcgcccactacgccatcatcgggcccggcctgcaggccaaggccacgcgcgaggcgcagaagcgggccgccgccggcatcatgaagaaccccaccgtggacgggatcaccgtgatcgacctcgacccgatcccctacgaccccaagttcgagaagcagctgggccaggtcatgctgctcgtgctgtgcgtgacccaggtcctgatgatgcgcacgacctgggccctctgcgaggcgctgaccctggccaccgggcccatcagcacgctctgggagggcaacccggggcgcttctggaacaccaccatcgccgtgtccatggccaacatcttccggggcagctacctggccggcgcggggctcctcttctccatcatgaagaacaccgccaacacgcgccggggcaccgggaacaccggcgagaccctgggcgagaagtggaagaaccgcctgaacgccctcgggaagtccgagttccagatctacaagaagtccggcatccaggaggtggaccggacgctggccaaggaggggatcaagcgcggcgagaccgaccaccacgcggtcagccgggggtccgccaagctgcgctggttcgtggagcggaacctcgtgacccccgagggcaaggtcgtggacctgggctgcgggcgcggcgggtggagctactactgcggcgggctgaagaacgtgaaggaggtcaagggcctcaccaagggcgggcccggccacgaggagcccatcccgatgtccacgtacgggtggaacctggtgcggctgcagagcggcgtggacgtcttcttcacgccgcccgagaagtgcgacaccctcctgtgcgacatcggggagtccagccccaacccgaccgtggaggccggccgcaccctgcgggtgctcaacctggtcgagaactggctgaacaacaacacgcagttctgcatcaaggtgctcaacccctacatgccctccgtgatcgagaagatggaggccctgcagcgcaagtacggcggggccctggtccggaacccgctgagccgcaacagcacccacgagatgtactgggtgtccaacgcgagcggcaacatcgtgtccagcgtcaacatgatctcccggatgctcatcaaccgcttcaccatgcggcacaagaaggccacctacgagcccgacgtggacctggggagcggcacgcgcaacatcgggatcgagtccgagacccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcggctcctgaccaagccgtgggacgtgatccccatggtcacccagatggccatgacggacaccacccccttcgggcagcagcgcgtgttcaaggagaaggtcgacacccggacgcaggagcccaaggagggcaccaagaagctgatgaagatcaccgcggagtggctctggaaggagctgggcaagaagaagaccccgcgcatgtgcacgcgggaggagttcacccgcaaggtgcggtccaacgccgccctgggggccatcttcaccgacgagaacaagtggaagtccgcccgcgaggcggtggaggactccggcttctgggagctcgtcgacaaggagcggaacctgcacctggaggggaagtgcgagacctgcgtgtacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtggagggcgaggggctccacaagctgggctacatcctgcgcgacgtcagcaagaaggagggcggggccatgtacgccgacgacacggccggctgggacacccggatcaccctcgaggacctgaagaacgaggagatggtgaccaaccacatggagggggagcacaagaagctggccgaggcgatcttcaagctcacgtaccagaacaaggtggtccgcgtgcagcggcccacgccccgcggcaccgtgatggacatcatcagccggcgcgaccagcgggggtccggccaggtcgtgacctacggcctgaacaccttcaccaacatggaggcccagctgatccgccagatggagggggagggcgtgttcaagagcatccagcagctcaccgtcaccgaggagatcgccgtgaagaactggctggtgcgcgtcgggcgggagcgcctgtcccggatggccatcagcggcgacgactgcgtggtgaagcccctcgacgaccgcttcgcctccgcgctgacggccctgaacgacatgggcaaggtccggaaggacatccagcagtgggagccgagccgcgggtggaacgactggacccaggtgcccttctgctcccaccacttccacgagctcatcatgaaggacggccgggtgctggtcgtgccctgccgcaaccaggacgagctgatcgggcgggcccgcatcagccagggcgccgggtggtccctccgggagaccgcctgcctgggcaagagctacgcgcagatgtggtccctgatgtacttccaccgccgggacctccgcctggccgccaacgccatctgcagcgccgtgccctcccactgggtcccgaccagccggaccacgtggtccatccacgcgacccacgagtggatgaccaccgaggacatgctgacggtgtggaaccgcgtgtggatccaggagaacccctggatggaggacaagacccccgtcgagagctgggaggagatcccctacctcggcaagcgggaggaccagtggtgcgggtccctgatcggcctgaccagccgcgccacctgggccaagaacatccagacggccatcaaccaggtgcggagcctcatcgggaacgaggagtacaccgactacatgccgtccatgaagcgcttccgccgggaggaggaggaggcgggcgtgctgtggtga

SEQ ID NO: 9628 - RNA, 9876 nt, synthetic construct
  misc_feature 1..9876: note = derived and/or modified CDS sequence (opt1) from DENV-2__KT187554__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggccctgttcctcgaggagatgctgcgcacccgggtggggaccaagcacgcgatcctgctcgtcgccgtgtccttcgtgaccctgatcacgggcaacatgagcttccgcgacctggggcgcgtcatggtgatggtgggcgccgccatgaccgacgacatcgggatgggcgtcacctacctcgccctgctggcggccttcaaggtgcggcccaccttcgccgccggcctcctgctgcgcaagctcacgtccaaggagctgatgatgaccaccatcgggatcgtgctgctcagccagtccaccatgcccgagacgatcctggagctgaccgacgccctcgcgctgggcatgatggtcctgaagatcgtgcggaacatggagaagtaccagctcgccgtcaccatcatggccatcctgtgcgtgccgaacgccgtgatcctgcagaacgcctggaaggtcagctgcaccacgctcgcggtggtgtccgtcagccccctgttcctgacctccagccagcagaaggccgactggatccccctcgccctgaccatcaaggggctgaaccccaccgccatcttcctcacgaccctgtcccgcaccagcaagaagcggtcctggccgctgaacgaggcgatcatggccgtgggcatggtgagcatcctcgcctccagcctgctgaagaacgacatccccatgaccggccccctcgtcgccgggggcctgctgacggtgtgctacgtgctcaccgggcgcagcgccgacctggagctggagcgggcggccgacgtccgctgggaggagcaggccgagatctccggcagctcccccatcctcagcatcaccatctccgaggacgggagcatgtccatcaagaacgaggaggaggagcagaccctgacgatcctgatccggaccggcctcctggtgatcagcggcctgttcccggtgtccatccccatcaccgccgccgcgtggtacctctgggaggtcaagaagcagcgcgccggggtgctgtgggacgtgcccagcccgccgcccgtcggcaaggccgagctggaggacggggcctaccggatcaagcagaagggcatcctcgggtactcccagatcggcgccggcgtgtacaaggaggggaccttccacaccatgtggcacgtgacgcgcggcgcggtcctgatgcacaaggggaagcggatcgagcccagctgggccgacgtgaagaaggacctgatctcctacggcgggggctggaagctcgagggcgagtggaaggagggggaggaggtgcaggtcctggccctggagcccggcaagaacccccgcgccgtgcagaccaagcccggcctgttcaagaccaacaccggcacgatcggggccgtgagcctggacttctcccccggcaccagcggctcccccatcgtcgacaagaaggggaaggtggtgggcctgtacgggaacggcgtcgtgacccggagcggcacctacgtgtccgcgatcgcccagacggagaagtccatcgaggacaaccccgagatcgaggacgacatcttccgcaagaagcggctcaccatcatggacctgcaccccggggccggcaagaccaagcgctacctgcccgccatcgtccgggaggcgatcaagcgcgggctgcggaccctcatcctggccccgacgcgcgtggtggccgccgagatggaggaggccctgcgcggcctccccatccggtaccagacccccgcgatccgcgccgagcacaccgggcgggagatcgtcgacctgatgtgccacgccaccttcacgatgcgcctgctcagccccatccgggtgccgaactacaacctgatcatcatggacgaggcccacttcaccgaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtcaccgacttcaagggcaagaccgtgtggttcgtgccgtccatcaaggccgggaacgacatcgccgcctgcctgcggaagaacggcaagaaggtcatccagctcagccgcaagaccttcgactccgagtacatcaagacgcggaccaacgactgggacttcgtggtgaccaccgacatcagcgagatgggcgcgaacttcaaggccgagcgcgtcatcgacccccggcgctgcatgaagcccgtgatcctgacggacggggaggagcgggtgatcctggccggccccatgccggtcacccactccagcgccgcccagcgccgggggcgcgtgggccgcaaccccaagaacgagaacgaccagtacatctacatgggggagcccctcgagaacgacgaggactgcgcgcactggaaggaggccaagatgctgctggacaacatctccacccccgagggcatcatcccgagcatgttcgagcccgagcgggagaaggtggacgccatcgacggcgagtaccgcctccgcggggaggcccgcaagaccttcgtcgacctgatgcggcgcggcgacctgcccgtgtggctcgcctaccgggtcgcggccgaggggatcaactacgccgaccgccggtggtgcttcgacggcgtgaagaacaaccagatcctggaggagaacgtggaggtcgagatctggacgaaggagggggagcgcaagaagctgaagccgcggtggctcgacgcccgcatctactccgaccccctggccctgaaggagttcaaggagttcgcggccggccgcaagagcctcaccctgaacctgatcaccgagatgggccgcctccccaccttcatgacgcagaaggcccggaacgccctggacaacctggcggtgctccacaccgccgaggccgggggccgcgcctacaaccacgccctgtccgagctgcccgagaccctcgagaccctgctgctcctgacgctgctcgcggccgtgaccgggggcatcttcctgttcctgatgagcggcaaggggatcggcaagatgaccctcgggatgtgctgcatcatcaccgcctccatcctgctgtggtacgcccagatccagccgcactggatcgccgcgagcatcatcctcgagttcttcctgatcgtcctgctcatccccgagcccgagaagcagcggacgccccaggacaaccagctgacgtacgtggtgatcgccatcctgaccgtcgtggccgccaccatggccaacgagatgggcttcctcgagaagaccaagaaggacttcgggctgggcagcacgaccacccagcagccggagtccaacatcctggacatcgacctccgccccgcgagcgcctggaccctgtacgccgtggccacgaccttcatcacccccatgctgcggcactccatcgagaacagctccgtcaacgtgagcctcaccgccatcgcgaaccaggccacggtgctgatgggcctggggaagggctggcccctctccaagatggacatcggggtcccgctgctggccatcggctgctacagccaggtgaaccccatcaccctcaccgccgcgctgctgctcctggtggcccactacgccatcatcgggcccggcctgcaggccaaggccacccgcgaggcgcagaagcgggccgccgccggcatcatgaagaaccccacggtcgacgggatcaccgtgatcgacctcgacccgatcccctacgaccccaagttcgagaagcagctgggccaggtgatgctgctcgtcctgtgcgtgacccaggtgctgatgatgcgcaccacgtgggccctctgcgaggcgctgaccctggccaccgggcccatctccaccctctgggagggcaacccggggcgcttctggaacacgaccatcgccgtcagcatggccaacatcttccggggctcctacctggccggcgcggggctcctcttcagcatcatgaagaacaccgccaacacccgccggggcacggggaacaccggcgagaccctgggcgagaagtggaagaaccgcctgaacgccctcgggaagtccgagttccagatctacaagaagtccggcatccaggaggtggaccggaccctggccaaggaggggatcaagcgcggcgagacggaccaccacgcggtgtcccgggggagcgccaagctgcgctggttcgtcgagcggaacctcgtgacccccgagggcaaggtggtcgacctgggctgcgggcgcggcgggtggtcctactactgcggcgggctgaagaacgtgaaggaggtgaagggcctcaccaagggcgggcccggccacgaggagcccatcccgatgagcacctacgggtggaacctggtccggctgcagtccggcgtggacgtgttcttcacgccgcccgagaagtgcgacaccctcctgtgcgacatcggggagagcagccccaacccgaccgtcgaggccggccgcaccctgcgggtgctcaacctggtggagaactggctgaacaacaacacccagttctgcatcaaggtcctcaacccctacatgccctccgtgatcgagaagatggaggccctgcagcgcaagtacggcggggccctggtgcggaacccgctgagccgcaactccacgcacgagatgtactgggtcagcaacgcgtccggcaacatcgtgagctccgtgaacatgatcagccggatgctcatcaaccgcttcaccatgcggcacaagaaggccacctacgagcccgacgtcgacctggggtccggcacccgcaacatcgggatcgagagcgagacgcccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctcctgaccaagccgtgggacgtgatccccatggtgacccagatggccatgaccgacacgacccccttcgggcagcagcgcgtcttcaaggagaaggtggacacccggacccaggagcccaaggagggcacgaagaagctgatgaagatcaccgcggagtggctctggaaggagctgggcaagaagaagaccccgcgcatgtgcacccgggaggagttcacgcgcaaggtccggagcaacgccgccctgggggccatcttcaccgacgagaacaagtggaagtccgcccgcgaggcggtggaggacagcggcttctgggagctcgtggacaaggagcggaacctgcacctggaggggaagtgcgagacctgcgtctacaacatgatgggcaagcgcgagaagaagctcggggagttcggcaaggccaagggctcccgggccatctggtacatgtggctgggggcccgcttcctggagttcgaggcgctcggcttcctgaacgaggaccactggttcagccgggagaacagcctgtccggggtggagggcgaggggctccacaagctgggctacatcctgcgcgacgtgagcaagcgggagggcggggccatgtacgccgacgacaccgccggctgggacacgcgcatcaccctcgaggacctgaagaacgaggagatggtcaccaaccacatggagggggagcacaagaagctggccgaggcgatcttcaagctcacctaccagaacaaggtggtgcgggtccagcgccccacgccccggggcaccgtgatggacatcatctcccgccgggaccagcgcgggagcggccaggtggtcacctacggcctgaacaccttcacgaacatggaggcccagctgatccgccagatggagggggagggcgtgttcaagtccatccagcagctcaccgtgaccgaggagatcgccgtcaagaactggctggtgcgggtggggcgcgagcggctgagccgcatggccatctccggcgacgactgcgtcgtgaagcccctcgacgaccggttcgccagcgcgctgaccgccctgaacgacatgggcaaggtgcgcaaggacatccagcagtgggagccgtcccgggggtggaacgactggacgcaggtccccttctgcagccaccacttccacgagctcatcatgaaggacggccgcgtgctggtggtcccctgccggaaccaggacgagctgatcgggcgcgcccggatctcccagggcgccgggtggagcctccgcgagaccgcctgcctgggcaagtcctacgcgcagatgtggaacctgatgtacttccaccggcgcgacctccggctggccgccaacgccatctgcagcgccgtgccctcccactgggtgccgaccagccgcaccacctggtccatccacgcgacgcacgagtggatgaccaccgaggacatgctgaccgtctggaaccgggtgtggatccaggagaacccctggatggaggacaagacgcccgtggagagctgggaggagatcccctacctcggcaagcgcgaggaccagtggtgcgggagcctgatcggcctgacctcccgggccacctgggccaagaacatccagaccgccatcaaccaggtccgcagcctcatcgggaacgaggagtacacggactacatgccgtccatgaagcgcttccggcgcgaggaggaggaggcgggcgtgctgtggtga

SEQ ID NO: 9629 - RNA, 9876 nt, synthetic construct
  misc_feature 1..9876: note = derived and/or modified CDS sequence (opt1) from DENV-2__KT187557__SS-prME
  source 1..9876: mol_type = other RNA
accgccggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccatgagccagcacaactaccgcccggggtaccacacccagaccgcgggcccctggcacctcgggcggctggagatggacttcgacttctgcgagggcacgaccgtggtggtcaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgacggccggccacgggcagatcgacaacttcagcctcggcgtcctgggcatggccctgttcctcgaggagatgctgcgcacccgggtggggaccaagcacgcgatcctgctcgtggccgtctccttcgtgaccctgatcacgggcaacatgagcttccgcgacctggggcgcgtgatggtcatggtgggcgccgccatgaccgacgacatcgggatgggcgtgacctacctcgccctgctggcggccttcaaggtccggcccaccttcgccgccggcctcctgctgcgcaagctcacgtccaaggagctgatgatgaccaccatcgggatcgtgctgctcagccagtccaccatgcccgagacgatcctggagctgaccgacgccctcgcgctgggcatgatggtgctgaagatcgtccggaacatggagaagtaccagctcgccgtgaccatcatggccatcctgtgcgtcccgaacgccgtgatcctgcagaacgcctggaaggtgagctgcaccacgctcgcggtcgtgtccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtcggcatggtgagcatcctggcctccagcctgctcaagaacgacatccccatgaccggccccctggtggccgggggcctgctcacggtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacaccatgtggcacgtgacgcgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacaccggcacgatcggggccgtgagcctggacttctcccccggcaccagcggctcccccatcgtggacaagaaggggaaggtcgtgggcctctacgggaacggcgtggtcacccggagcggcacctacgtgtccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtcgtggccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctccggaagaacggcaagaaggtgatccagctgagccgcaagaccttcgactccgagtacatcaagacgcggaccaacgactgggacttcgtcgtgaccaccgacatcagcgagatgggcgcgaacttcaaggccgagcgcgtgatcgacccccggcgctgcatgaagcccgtcatcctgacggacggggaggagcgggtgatcctcgccggccccatgccggtgacccactccagcgccgcccagcgccgggggcgcgtcggccgcaaccccaagaacgagaacgaccagtacatctacatgggggagcccctggagaacgacgaggactgcgcgcactggaaggaggccaagatgctgctcgacaacatctccacccccgagggcatcatcccgagcatgttcgagcccgagcgggagaaggtggacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggacgaaggagggggagcgcaagaagctcaagccgcggtggctggacgcccgcatctactccgaccccctggccctcaaggagttcaaggagttcgcggccggccgcaagagcctgaccctgaacctcatcaccgagatgggccgcctgcccaccttcatgacgcagaaggcccggaacgccctggacaacctcgcggtcctgcacaccgccgaggccgggggccgcgcctacaaccacgccctgtccgagctccccgagaccctggagaccctgctcctgctgacgctcctggcggccgtgaccgggggcatcttcctgttcctcatgagcggcaaggggatcggcaagatgaccctggggatgtgctgcatcatcaccgcctccatcctgctctggtacgcccagatccagccgcactggatcgccgcgagcatcatcctggagttcttcctgatcgtgctcctgatccccgagcccgagaagcagcggacgccccaggacaaccagctgacgtacgtcgtgatcgccatcctcaccgtggtcgccgccaccatggccaacgagatgggcttcctggagaagaccaagaaggacttcgggctgggcagcacgaccacccagcagccggagtccaacatcctcgacatcgacctgcgccccgcgagcgcctggaccctgtacgccgtggccacgaccttcatcacccccatgctccggcactccatcgagaacagctccgtgaacgtcagcctgaccgccatcgcgaaccaggccacggtgctgatgggcctcgggaagggctggcccctgtccaagatggacatcggggtgccgctgctcgccatcggctgctacagccaggtcaaccccatcaccctgaccgccgcgctgctcctgctggtggcccactacgccatcatcgggcccggcctccaggccaaggccacccgcgaggcgcagaagcgggccgccgccggcatcatgaagaaccccacggtggacgggatcaccgtcatcgacctggacccgatcccctacgaccccaagttcgagaagcagctgggccaggtgatgctcctggtgctgtgcgtcacccaggtgctcatgatgcgcaccacgtgggccctgtgcgaggcgctgaccctcgccaccgggcccatctccaccctgtgggagggcaacccggggcgcttctggaacacgaccatcgccgtgagcatggccaacatcttccggggctcctacctggccggcgcggggctcctgttcagcatcatgaagaacaccgccaacacccgccggggcacggggaacaccggcgagaccctgggcgagaagtggaagaaccgcctcaacgccctggggaagtccgagttccagatctacaagaagtccggcatccaggaggtcgaccggaccctggccaaggaggggatcaagcgcggcgagacggaccaccacgcggtgtcccgggggagcgccaagctccgctggttcgtggagcggaacctggtcacccccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacctacgggtggaacctggtgcggctccagtccggcgtcgacgtgttcttcacgccgcccgagaagtgcgacaccctgctgtgcgacatcggggagagcagccccaacccgaccgtggaggccggccgcaccctccgggtcctgaacctggtggagaactggctcaacaacaacacccagttctgcatcaaggtgctgaacccctacatgccctccgtcatcgagaagatggaggccctgcagcgcaagtacggcggggccctggtgcggaacccgctcagccgcaactccacgcacgagatgtactgggtgagcaacgcgtccggcaacatcgtcagctccgtgaacatgatcagccggatgctgatcaaccgcttcaccatgcggcacaagaaggccacctacgagcccgacgtggacctggggtccggcacccgcaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtcaacggcgtggtgcggctgctgaccaagccgtgggacgtcatccccatggtgacccagatggccatgaccgacacgacccccttcgggcagcagcgcgtgttcaaggagaaggtcgacacccggacccaggagcccaaggagggcacgaagaagctcatgaagatcaccgcggagtggctgtggaaggagctgggcaagaagaagaccccgcgcatgtgcacccgggaggagttcacgcgcaaggtgcggagcaacgccgccctcggggccatcttcaccgacgagaacaagtggaagtccgcccgcgaggcggtcgaggacagcggcttctgggagctggtggacaaggagcggaacctgcacctcgaggggaagtgcgagacctgcgtgtacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaacagcctctccggggtcgagggcgaggggctgcacaagctgggctacatcctccgcgacgtgagcaagaaggagggcggggccatgtacgccgacgacaccgccggctgggacacgcggatcaccctggaggacctgaagaacgaggagatggtgaccaaccacatggagggggagcacaagaagctcgccgaggcgatcttcaagctgacctaccagaacaaggtcgtgcgcgtgcagcggcccacgccccgcggcaccgtcatggacatcatctcccggcgcgaccagcgggggagcggccaggtggtgacctacggcctgaacaccttcacgaacatggaggcccagctcatccgccagatggagggggagggcgtcttcaagtccatccagcagctgaccgtgaccgaggagatcgccgtgaagaactggctggtccgcgtggggcgggagcgcctcagccggatggccatctccggcgacgactgcgtggtcaagcccctggacgaccgcttcgccagcgcgctgaccgccctcaacgacatgggcaaggtgcggaaggacatccagcagtgggagccgtcccgcgggtggaacgactggacccaggtgcccttctgcagccaccacttccacgagctgatcatgaaggacggccgggtcctggtggtgccctgccgcaaccaggacgagctcatcgggcgggcccgcatctcccagggcgccgggtggagcctgcgggagaccgcctgcctgggcaagtcctacgcgcagatgtggaacctcatgtacttccaccgccgggacctgcgcctggccgccaacgccatctgcagcgccgtcccctcccactgggtgccgaccagccggaccacctggtccatccacgcgacgcacgagtggatgaccaccgaggacatgctcaccgtgtggaaccgcgtctggatccaggagaacccctggatggaggacaagacgcccgtggagagctgggaggagatcccctacctgggcaagcgggaggaccagtggtgcgggagcctgatcggcctcacctcccgcgccacctgggccaagaacatccagaccgccatcaaccaggtgcggagcctgatcgggaacgaggagtacacggactacatgccgtccatgaagcgcttccgccgggaggaggaggaggcgggcgtcctgtggtga

SEQ ID NO: 9630 - RNA, 9876 nt, synthetic construct
  misc_feature 1..9876: note = derived and/or modified CDS sequence (opt1) from DENV-2__JQ045670__SS-prME
  source 1..9876: mol_type = other RNA
agcgccggcatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccgccatggccgacgacatcgggatgggcgtgacctacctggcgctgctcgccgccttcaaggtgcgccccacgttcgccgccggcctgctgctccggaagctgacctccaaggagctgatgatgaccaccatcgggatcgtcctcctgagccagtccacgatccccgagaccgtgctggagctcaccgacgcgctggccctgggcatgatggtgctcaagatcgtccgcaacatggagaagtaccagctggccgtgaccatcatggccatcctgtgcgtcccgaacgccgtgatcctccagaacgcgtggaaggtgagctgcacgatcctggccgtcgtgtccgtgagccccctgctcctgacctccagccagcagaagaccgactggatccccctggccctcaccatcaaggggctgaaccccacggccatcttcctgaccaccctctcccgcaccaacaagaagcggagctggccgctgaacgaggcgatcatggccgtcggcatggtgtccatcctggccagctccctcctgaagaacgacatccccatgacgggccccctggtggccgggggcctcctgaccgtctgctacgtgctgaccgggcgcagcgccgacctcgagctggagcgggcgaccgacgtgaagtgggaggaccaggccgagatctccggcagcagccccatcctgtccatcacgatcagcgaggacgggtccatgagcatcaagaacgaggaggaggagcagaccctcaccatcctgatccgcaccggcctgctcgtcatctccggcctgttcccgatcagcatccccatcacggccgccgcctggtacctgtgggaggtgaagaagcagcgggcgggggtgctctgggacgtccccagcccgccgcccatgggcaaggccgagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggcggacgtgaagaaggacctgatcagctacggcgggggctggaagctggagggcgagtggaaggagggggaggaggtgcaggtcctcgccctggagcccggcaagaacccccgggccgtgcagaccaagcccgggctgttcaagacgaacaccggcaccatcggggccgtgtccctcgacttcagccccggcacctccggcagccccatcatcgacaagaaggggaaggtcgtgggcctgtacgggaacggcgtggtcacgcgctccggcgcctacgtgagcgcgatcgcccagaccgagaagtccatcgaggacaaccccgagatcgaggacgacatcttccggaagcgccggctgaccatcatggacctgcaccccggggccggcaagaccaagcgctacctccccgccatcgtgcgggaggcgatcaagcgcgggctgcggacgctgatcctcgccccgacccgcgtcgtggccgccgagatggaggaggccctgcggggcctgcccatccgctaccagacccccgcgatccgggccgagcacaccgggcgcgagatcgtggacctcatgtgccacgccacgttcaccatgcgcctgctgagccccgtccgggtgccgaactacaacctcatcatcatggacgaggcccacttcaccgaccccgcctccatcgcggcccgcggctacatcagcacccgggtggagatgggcgaggccgccgggatcttcatgacggccacgccgcccggcagccgcgacccgttcccccagtccaacgcgcccatcatggacgaggagcgggagatccccgagcgcagctggaactccgggcacgagtgggtcaccgacttcaagggcaagaccgtgtggttcgtgccgagcatcaaggccgggaacgacatcgccgcctgcctgcggaagaacggcaagaaggtcatccagctgtcccgcaagacgttcgacagcgagtacgtgaagacccggaccaacgactgggacttcgtggtcaccacggacatctccgagatgggcgcgaacttcaaggccgagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgcgagaaggtggacgccatcgacggcgagtaccggctgcgcggggaggcccgcaagacgttcgtcgacctcatgcggcgcggcgacctgcccgtgtggctggcctacaaggtggcggccgaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgcggccggccgcaagagcctgaccctcaacctgatcaccgagatgggccggctgcccacgttcatgacccagaagacccgcgacgccctcgacaacctggccgtcctgcacaccgcggaggccgggggccgggcctacaaccacgccctctccgagctgcccgagacgctggagaccctcctgctgctcaccctgctggccaccgtgaccggcgggatcttcctcttcctgatgagcgggcgcgggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcggacgccccaggacaaccagctcacctacgtcgtgatcgccatcctgacggtggtcgcggccaccatggccaacgagatgggcttcctggagaagaccaagaaggacttcgggctcggctccatcgccacccagcagccggagagcaacatcctggacatcgacctgcgccccgcctccgcgtggacgctctacgccgtggccaccaccttcgtgacccccatgctgcggcacagcatcgagaacagctccgtcaacgtgagcctgacggccatcgccaaccaggcgaccgtgctcatgggcctggggaagggctggcccctgtccaagatggacatcggggtcccgctcctggccatcggctgctacagccaggtgaaccccatcaccctgaccgccgccctcctgctgctcgtggcgcactacgccatcatcgggcccggcctgcaggccaaggccacgcgcgaggcccagaagcgggcggccgccggcatcatgaagaaccccaccgtcgacgggatcaccgtgatcgacctggacccgatcccctacgaccccaagttcgagaagcagctcggccaggtgatgctgctgatcctctgcgtcacccaggtgctgatgatgcgcacgacctgggccctgtgcgaggccctcaccctggcgaccgggcccatctccacgctgtgggagggcaacccggggcggttctggaacaccaccatcgccgtgagcatggccaacatcttccgcggctcctacctcgccggcgccgggctgctgttcagcatcatgaagaacaccacgaacacccggcgcggcaccgggaacatcggcgagaccctcggcgagaagtggaagtcccgcctgaacgcgctggggaagtccgagttccagacgtacaagaagtccggcatccaggaggtcgaccggaccctcgccaaggaggggatcaagcgcggcgagaccgaccaccacgccgtgagccgggggtccgccaagctgcgctggttcgtggagcggaacctggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggcgggccggacgctgcgcgtcctgaacctcgtggagaactggctgaacaacaacacccagttctgcatcaaggtgctgaacccctacatgccctccgtcatcgagaagatggaggccctgcagcggaagtacggcggggccctcgtgcgcaacgacctgagccggaacagcacccacgagatgtactgggtgtccaacgccagcggcaacatcgtctccagcgtgaacatgatctcccgcatgctgatcaaccggttcaccatgcgccacaagaaggccacctacgagccggacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcgtaccacggctcctacgagaccaagcagacggggagcgcctccagcatggtcaacggcgtggtgcggctgctcaccaagccctgggacgtcctgccgaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagacgccccggatgtgcacgcgcgaggagttcacccggaaggtgcgctccaacgccgcgctgggggccatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggcgatctggtacatgtggctgggcgcccgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgcggacgacacggccgggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggccgacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggtggcggtgcagaactggctggcccgggtcgggcgcgagcgcctgagccggatggccatctccggcgacgactgcgtggtgaagcccctcgacgaccgcttcgccaacgccctgacggcgctgaacgacatgggcaagatccggaaggacatccagcagtgggagcccagcaaggggtggaacgactggacccaggtcccgttctgctcccaccacttccacgagctcatcatgaaggacggccgcgtgctggtggtcccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtgccctcccactgggtgcccaccagccgcacgacctggtccatccacgccaagcacgagtggatgaccaccgaggacatgctgaccgtctggaaccgggtgtggatccgcgagaacccgtggatggaggacaagacgcccgtggagagctgggaggagatcccctacctcggcaagcgggaggaccagtggtgcgggtccctgatcggcctgaccagccgcgcgacctgggccaagaacatccaggccgccatcaaccaggtccggtccctcatcgggaacgaggagtacaccgactacatgcccagcatgaagcgcttccggcgcgaggaggaggaggcgggcgtgctgtggtga

SEQ ID NO: 9631 - RNA, 9876 nt, synthetic construct
  misc_feature 1..9876: note = derived and/or modified CDS sequence (opt1) from DENV-2__JQ045686__SS-prME
  source 1..9876: mol_type = other RNA
agcgcggggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgtcatcctggcgtacaccatcgggaccacccacttccagcgcgtgctcatcttcatcctgctgacggccgtggccccctccatgaccatgcggtgcatcggcatcagcaaccgcgacttcgtcgagggcgtgtccgggggcagctgggtggacatcgtcctcgagcacgggtcctgcgtgaccaccatggccaagaacaagcccacgctggacttcgagctgatcaagaccgaggcgaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcggcctgttcggcaagggcgggatcgtgacgtgcgccatgttcacgtgcaagaagaacatggagggcaagatcgtgcagcccgagaacctggagtacaccatcgtcgtgacgccccactccggggaggagcacgccgtgggcaacgacacggggaagcacggccaggagatcaaggtcaccccgcagagctccatcaccgaggcggagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggccatgcacacggcgctgaccggcgccaccgagatccagatgagctccgggaacctcctgttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgccaagcgcatggcgatcctgggcgacaccgcctgggacttcgggtccctgggcggggtcttcacgagcatcggcaaggccctccaccaggtgttcggggccatctacggcgccgcgttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgccatccagaaggcgcaggaggaggggatctgcggcatccgctccgtgacgcggctggagaacctcatgtggaagcagatcacccccgagctgaaccacatcctggccgagaacgaggtgaagctcaccatcatcaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggccgagtgcccgaacaccaaccgcgcgtggaacagcctggaggtcgaggactacgggttcggcgtgttcaccaccaacatctggctcaagctgaaggagaagcaggacgccttctgcgactccaagctgatgagcgccgccatcaaggacaaccgggccgtgcacgcggacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgccggcccctggcacctggggaagctggagatggacttcaacttctgcgacggcaccaccgtcatcgtgacggaggactgcgggaaccggggcccctccctccgcaccaccaccgcgagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgccatcctcctggtggcggtgtccttcgtcaccctgatcaccggcaacatgagcttcaaggacctcgggcgggtggtggtcatggtgggcgccaccatgacggacgacatcgggatgggcgtgacctacctggccctgctcgccgccttcaaggtccgccccaccttcgcggccggcctgctgctccggaagctgacctccaaggagctgatgatgacgaccatcgggatcgtgctcctgagccagtccaccatccccgagaccgtgctggagctcacggacgccctggccctgggcatgatggtcctcaagatcgtgcgcaacatggagaagtaccagctggccgtcaccatcatggcgatcctgtgcgtgccgaacgccgtgatcctccagaacgcctggaaggtcagctgcaccatcctggccgtggtgtccgtcagccccctgctcctgacctccagccagcagaagacggactggatccccctggccctcaccatcaaggggctgaaccccaccgcgatcttcctgaccacgctctcccgcaccaacaagaagcggagctggccgctgaacgaggccatcatggccgtgggcatggtgtccatcctggccagctccctcctgaagaacgacatccccatgaccggccccctggtcgccggcgggctcctgaccgtgtgctacgtgctgacggggcgcagcgccgacctcgagctggagcgggccaccgacgtcaagtgggaggaccaggccgagatctccgggagcagccccatcctgtccatcaccatcagcgaggacgggtccatgagcatcaagaacgaggaggaggagcagaccctcacgatcctgatccgcaccggcctgctcgtgatctccggcctgttcccgatcagcatccccatcaccgccgcggcctggtacctgtgggaggtgaagaagcagcgggccggggtcctctgggacgtgcccagcccgccgcccatgggcaaggccgagctggaggacggggcctaccgcatcaagcagaagggcatcctggggtacagccagatcggcgcgggcgtgtacaaggaggggaccttccacaccatgtggcacgtcacgcggggcgccgtgctcatgcacaaggggaagcgcatcgagccctcctgggccgacgtgaagaaggacctgatcagctacggcgggggctggaagctggagggcgagtggaaggagggggaggaggtccaggtgctcgccctggagcccggcaagaacccccgggccgtgcagaccaagcccgggctgttcaagaccaacaccggcacgatcggggcggtctccctcgacttcagccccggcacctccggcagccccatcatcgacaagaaggggaaggtggtgggcctgtacgggaacggcgtcgtgacccgctccggcgcctacgtgagcgccatcgcccagaccgagaagtccatcgaggacaaccccgagatcgaggacgacatcttccggaagcgccggctgacgatcatggacctgcaccccggggccggcaagaccaagcgctacctccccgcgatcgtccgggaggccatcaagcgcgggctgcggaccctgatcctcgccccgacccgcgtggtggccgcggagatggaggaggccctgcggggcctgcccatccgctaccagacgcccgccatccgggccgagcacaccgggcgcgagatcgtcgacctcatgtgccacgccaccttcaccatgcgcctgctgagccccgtgcgggtgccgaactacaacctcatcatcatggacgaggcgcacttcacggaccccgcctccatcgccgcccgcggctacatcagcacccgggtcgagatgggcgaggccgcggggatcttcatgaccgccacgccgcccggcagccgcgacccgttcccccagtccaacgcccccatcatcgacgaggagcgggagatccccgagcgcagctggaactccgggcacgagtgggtgacggacttcaagggcaagaccgtgtggttcgtcccgagcatcaaggccgggaacgacatcgccgcgtgcctgcggaagaacggcaagaaggtgatccagctgtcccgcaagaccttcgacagcgagtacgtgaagacccggacgaacgactgggacttcgtcgtgaccaccgacatctccgagatgggcgccaacttcaaggccgagcgcgtgatcgacccccggcgctgcatgaagcccgtcatcctcaccgacggggaggagcgggtgatcctggccggccccatgccggtgacgcacagctccgcggcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtcgacgccatcgtgggcgagtaccggctgcgcggggaggcgcgcaagaccttcgtggacctcatgcggcgcggcgacctgcccgtctggctggcctacaaggtggccgccgaggggatcaactacgccgaccggcgctggtgcttcgacggcatcaagaacaaccagatcctcgaggagaacatggaggtcgagatctggaccaaggagggggagcggaagaagctgaagccgcgctggctggacgcgcggatctactccgaccccctcgccctgaaggagttcaaggagttcgccgccggccgcaagagcctgacgctcaacctgatcaccgagatgggccggctgcccaccttcatgacccagaagacgcgcgacgccctcgacaacctggcggtgctgcacaccgccgaggccgggggccgggcctacaaccacgcgctctccgagctgcccgagaccctggagaccctcctgctgctcacgctgctggccaccgtgaccgggggcatcttcctcttcctgatgagcggccgcgggatcggcaagatgaccctggggatgtgctgcatcatcaccgcctccatcctcctgtggtacgcccagatccagccgcactggatcgccgcgagcatcatcctggagttcttcctcatcgtcctgctgatccccgagcccgagaagcagcggacgccccaggacaaccagctcacctacgtggtgatcgccatcctgaccgtcgtggccgccaccatggccaacgagatgggcttcctggagaagacgaagaaggacctcgggctgggctccatcgcgacccagcagccggagagcaacatcctggacatcgacctccgccccgcctccgcctggaccctgtacgccgtggccaccacgttcgtcacccccatgctgcggcacagcatcgagaacagctccgtgaacgtgagcctcaccgcgatcgccaaccaggccaccgtcctgatgggcctggggaagggctggcccctctccaagatggacatcggggtgccgctgctggccatcggctgctacagccaggtgaaccccatcacgctcaccgccgcgctgctgctcctggtcgcccactacgccatcatcgggcccggcctgcaggccaaggcgacccgcgaggcccagaagcgggccgccgccggcatcatgaagaaccccaccgtggacgggatcacggtgatcgacctcgacccgatcccctacgaccccaagttcgagaagcagctgggccaggtcatgctgctcgtgctgtgcgtgacccaggtcctgatgatgcgcaccacctgggcgctctgcgaggccctgacgctggccaccgggcccatctccaccctctgggagggcaacccggggcggttctggaacaccacgatcgccgtgagcatggccaacatcttccgcggctcctacctggcgggcgccgggctcctcttcagcatcatgaagaacaccaccaacacccggcgcggcacggggaacatgggcgagaccctgggcgagaagtggaagtcccgcctgaacgccctcgggaagtccgagttccagatctacaagaagtccggcatccaggaggtggaccggaccctggccaaggaggggatcaagcgcggcgagaccgaccaccacgccgtcagccgggggtccgcgaagctgcgctggttcgtggagcggaacatggtgacgcccgagggcaaggtcgtggacctcggctgcgggcgcggcgggtggagctactactgcggcgggctgaagaacgtgcgggaggtcaagggcctgaccaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgacggtggaggccggccggaccctgcgcgtgctgaacctcgtcgagaactggctgaacaacaacacccagttctgcatcaaggtgctgaacccctacatgccctccgtgatcgagaagatggaggccctgcagcggaagtacggcggggccctcgtccgcaacccgctgagccggaacagcacccacgagatgtactgggtgtccaacgcgagcggcaacatcgtgtccagcgtcaacatgatctcccgcatgctgatcaaccggttcaccatgcgccacaagaaggccacgtacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcggctgctcaccaagccgtgggacgtgctgcccaccgtcacgcagatggccatgaccgacaccacccccttcgggcagcagcgcgtgttcaaggagaaggtggacacgcgcacccaggagcccaaggagggcaccaagaagctgatgaagatcaccgcggagtggctctggaaggagctgggcaagaagaagacgccgcggatgtgcacccgcgaggagttcacccggaaggtccgctccaacgccgccctgggggccatcttcaccgacgagaacaagtggaagtccgcccgggaggcggtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcccgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgcgatgtacgccgacgacaccgccgggtgggacacccgggtgaccctcgaggacctgaagaacgaggagatggtgacgaaccacatggagggcgagcacaagaagctggccgaggcgatcttcaagctcacctaccagaacaaggtcgtgcgcgtgcagcggcccacgccccgggggaccgtcatggacatcatcagccggcgcgaccagcggggctccggccaggtggggacgtacggcctgaacaccttcaccaacatggaggcccagctgatccgccagatggagggggagggcgtgttcaagaacatccagcacctcaccgtcacggaggaggtggccgtgaagaactggctggcccgggtcgggcgcgagcgcctgagccggatggccatctccggcgacgactgcgtggtgaagcccctcgacgaccgcttcgcgaacgccctgaccgccctgaacgacatgggcaagatccggaaggacatccagcagtgggagccgagccgcgggtggaacgactggacccaggtccccttctgctcccaccacttccacgagctcatcatgaaggacggccgggtgctggtggtcccctgccgcaaccaggacgagctgatcgggcgggcccgcatcagccagggcgccgggtggtccctccgggagaccgcgtgcctgggcaagagctacgcccagatgtggtccctgatgtacttccaccgccgggacctccgcctggccgccaacgccatctgcagcgcggtgccctcccactgggtgccgacgagccggaccacctggtccatccacgccaagcacgagtggatgaccaccgaggacatgctgacggtctggaaccgcgtgtggatccgggagaacccctggatggaggacaagacccccgtggagagctgggaggagatcccctacctcggcaagcgcgaggaccagtggtgcgggtccctgatcggcctgaccagccgggccacctgggccaagaacatccaggccgcgatcaaccaggtccgctccctcatcgggaacgaggagtacacggactacatgccgagcatgaagcggttccgccgcgaggaggaggaggccggcgtgctgtggtga

SEQ ID NO: 9632 - RNA, 9876 nt, synthetic construct
  misc_feature 1..9876: note = derived and/or modified CDS sequence (opt1) from DENV-2__KU094070__SS-prME
  source 1..9876: mol_type = other RNA
accgccggcatgatcatcatgctgatccccaccgtgatggccttccacctcaccacccggaacggggagccccacatgatcgtgagccggcaggagaagggcaagagcctgctgttcaagaccgaggacggggtgaacatgtgcaccctcatggcgatggacctgggcgagtggctggaggacaagatcacctacaagtgccccctcctgcggcagaacgagcccgaggacatcgactgctggtgcaacagcacctccacctgggtgacctacgggacctgcaccaccaccggcgagcaccggcgcgagaagcggagcgtcgccctggtgccccacgtgggcatggggctcgagacccgcaccgagacctggatgtccagcgagggcgcctggaagcacgcccagcggatcgagacctggatcctgcgccaccccgggttcacgatcatggccgcgatcctggcctacaccatcggcaccacccacttccagcgggccctcatcttcatcctgctgacggccgtcgcgccctccatgaccatgcgctgcatcgggatcagcaaccgggacttcgtggagggcgtgtccggcgggagctgggtcgacatcgtgctcgagcacggctcctgcgtgaccaccatggccaagaacaagcccacgctggacttcgagctgatcaagaccgaggccaagcagcccgccaccctccgcaagtactgcatcgaggccaagctgaccaacacgaccaccgagagccggtgcccgacccagggggagccctccctgaacgaggagcaggacaagcgcttcgtctgcaagcacagcatggtggaccggggctggggcaacgggtgcggcctcttcgggaagggctccatcgtgacgtgcgcgatgttcacgtgcaagaagatcatgaaggggaaggtcgtgcagcccgagaacctggagtacaccatcgtgatcacgccccacagcggcgaggagcacgccgtcggcaacgacacggggaagcacggcaaggagatcaagatcaccccgcagtccagcatcaccgaggccgagctgaccgggtacggcaccgtgacgatggagtgcagcccccggaccgggctcgacttcaacgagatggtgctgctgcagatggagaacaaggcctggctcgtccaccggcagtggttcctggacctgcccctcccctggctgccgggcgccgacacccagggcagcaactggatccagaaggagaccctggtgacgttcaagaacccccacgcgaagaagcaggacgtggtcgtgctcgggagccaggagggcgccatgcacaccgccctgaccggggccaccgagatccagatgtccagcggctacctgctgttcacggggcacctgaagtgccgcctgcggatggacaagctccagctgaagggcatgtcctacagcatgtgcaccggcaagttcaaggtcgtgaaggagatcgccgagacccagcacgggaccatcgtgatccgcgtccagtacgagggcgacgggtccccctgcaagatccccttcgagatcatggacctggagaagcggcacgtgctcggccgcctgatcacggtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagaccaccatgcgcggggccaagcggatggccatcctgggcgacacggcctgggacttcggcagcctcggcggggtcttcacctccatcgggaaggccctccaccaggtgttcggggcgatctacggggccgccttcagcggcgtgtcctggaccatgaagatcctgaccggcgtcatcatcacgtggatcgggatgaacagccgctccaccagcctgtccgtgagcctggtgctcgtcggcgccgtgaccctgtacctgggggtgatggtccaggcggactccggctgcgtggtgagctggaagaacaaggagctcaagtgcgggagcggcatcttcatcaccgacaacgtccacacgtggaccgagcagtacaagttccagcccgagtcccccagcaagctggcctccgccatccagaaggcccacgaggagggcatctgcgggatccggagcgtgacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctgggggaaggcgaagatgctcagcacggagtcccacaaccagaccttcctgatcgacggccccgagaccgccgagtgcccgaacaccaaccgggcctggaacagcctggaggtcgaggactacggcttcggggtgttcacgaccaacatctggctcaagctgcgcgaggagcaggacgtgttctgcgactccaagctgatgagcgccgccatcaaggacaaccgggcggtccacgccgacatgggctactggatcgagtccgccctcaacgacacctggaagatcgagaaggccagcttcatcgaggtgaagtcctgccactggcccaagagccacaccctgtggtccaacggggtgctggagagcgagatgatcatccccaagaacttcgccggccccgtcagccagcacaactaccgcccgggctaccacacccagacggcggggccctggcacctcggcaagctggagatggacttcgacttctgcgaggggaccaccgtggtggtcaccgaggactgcggcaaccgggggccctccctgcgcacgaccaccgccagcggcaagctcatcaccgagtggtgctgccggtcctgcacgctgcccccgctgcgctaccggggcgaggacgggtgctggtacggcatggagatccgccccctcaaggagaaggaggagaacctggtgaacagcctggtgaccgccgggcacggccagatcgacaacttctccctcggggtcctgggcatggccctgttcctcgaggagatgctgcggacccgcgtgggcaccaagcacgcgatcctgctcgtggccgtcagcttcgtgacgctgatcaccgggaacatgtccttccgggacctgggccgcgtgatggtcatggtgggggccaccatgaccgacgacatcggcatgggggtgacgtacctcgccctgctggccgcgttcaaggtccgccccaccttcgccgccggcctcctgctgcggaagctcaccagcaaggagctgatgatgaccacgatcggcatcgtgctgctctcccagagcaccatccccgagaccatcctggagctgaccgacgccctcgccctggggatgatggtgctgaagatggtccgcaagatggagaagtaccagctcgcggtgacgatcatggccatcctgtgcgtgccgaacgccgtcatcctgcagaacgcctggaaggtgtcctgcaccatcctcgccgtcgtgagcgtgagccccctgttcctgaccagctcccagcagaaggcggactggatccccctcgccctgaccatcaagggcctgaaccccacggccatcttcctcaccaccctgagccggaccaacaagaagcgctcctggccgctgaacgaggccatcatggcggtcgggatggtgagcatcctcgcctccagcctgctgaagaacgacatccccatgacgggccccctcgtggccggcgggctgctgaccgtctgctacgtgctcaccggccggagcgccgacctggagctggagcgcgccgcggacgtgaagtgggaggaccaggccgagatctccgggagctcccccatcctcagcatcaccatctccgaggacggcagcatgtccatcaagaacgaggaggaggagcagacgctgaccatcctgatccggaccgggctcctggtcatcagcggcctgttcccggtgtccatccccatcaccgccgccgcctggtacctctgggaggtgaagaagcagcgcgcgggcgtcctgtgggacgtgccctccccgccgcccgtggggaaggccgagctggaggacggcgcctaccggatcaagcagaaggggatcctcggctactcccagatcggggccggcgtctacaaggagggcaccttccacacgatgtggcacgtgacccgcggggccgtgctgatgcacaagggcaagcggatcgagcccagctgggcggacgtcaagaaggacctgatctcctacgggggcgggtggaagctcgagggcgagtggaaggagggcgaggaggtccaggtgctggccctggagcccgggaagaacccccgcgccgtccagaccaagcccggcctcttcaagaccaacgccgggacgatcggcgccgtgagcctggacttctcccccgggaccagcggctcccccatcatcgacaagaagggcaaggtggtcgggctgtacggcaacggggtggtgacccggagcggcgcgtacgtctccgccatcgcccagaccgagaagtccatcgaggacaaccccgagatcgaggacgacatcttccgcaagcggaagctcacgatcatggacctgcaccccggcgccgggaagaccaagcgctacctgcccgcgatcgtgcgggaggccatcaagcgcggcctgcggaccctcatcctggccccgacccgcgtggtcgccgccgagatggaggaggcgctgcgggggctccccatccgctaccagacgcccgccatccgcgccgagcacaccggccgggagatcgtggacctgatgtgccacgccaccttcaccatgcgcctgctcagccccgtgcgggtcccgaactacaacctgatcatcatggacgaggcccacttcacggaccccgcgtccatcgccgcccgcgggtacatcagcacccgggtggagatgggcgaggccgccggcatcttcatgaccgcgacgccgcccgggtcccgcgacccgttcccccagagcaacgcccccatcatggacgaggagcgggagatccccgagcgctcctggagctccggccacgagtgggtgacggacttcaaggggaagaccgtctggttcgtgccgagcatcaaggccggcaacgacatcgccgcgtgcctgcggaagaacgggaagaaggtgatccagctctcccgcaagaccttcgacagcgagtacgtcaagacccggacgaacgactgggacttcgtggtgaccaccgacatctccgagatgggcgccaacttcaaggccgagcgcgtcatcgacccccggcgctgcatgaagcccgtgatcctgaccgacggcgaggagcgggtgacgctggccgggcccatgccggtcacccacagctccgccgcgcagcgccggggccgcatcgggcggaaccccaagaacgagaacgaccagtacatctacatgggcgagcccctcgagaacgacgaggactgcgcccactggaaggaggccaagatgctgctggacaacatcaacacccccgaggggatcatcccgagcatgttcgagcccgagcgcgagaaggtggacgccatcgacggcgagtaccgcctccggggcgaggcccgcaagaccttcgtggacctgatgcggcgcggggacctgcccgtctggctcgcgtaccgggtggccgccgagggcatcaactacgccgaccgccggtggtgcttcgacgggatcaagaacaaccagatcctggaggagaacgtggaggtcgagatctggacgaaggagggcgagcgcaagaagctgaagccgcggtggctcgacgcccgcatctactccgaccccctggcgctgaaggagttcaaggagttcgccgccgggcgcaagagcctcaccctgaacctgatcaccgagatgggccgcctccccaccttcatgacgcagaaggcccgggacgcgctggacaacctggccgtgctccacaccgccgaggccggcgggcgcgcctacaaccacgcgctgtccgagctgcccgagaccctcgagaccctgctgctcctgacgctgctcgccaccgtcaccggcgggatcttcctgttcctgatgagcggccggggcatcgggaagatgaccctcggcatgtgctgcatcatcaccgcctccatcctgctgtggtacgcccagatccagccgcactggatcgccgcgagcatcatcctcgagttcttcctgatcgtgctgctcatccccgagcccgagaagcagcgcacgccccaggacaaccagctgacctacgtggtcatcgccatcctgaccgtggtggccgccaccatggccaacgagatggggttcctcgagaagacgaagaaggacctgggcctggggagcatcaccacccagcagccggagtccaacatcctcgacatcgacctgcggcccgcgagcgcctggaccctgtacgccgtcgccacgaccttcgtgacccccatgctccgccactccatcgagaacagctccgtgaacgtcagcctgaccgccatcgcgaaccaggccacggtgctgatgggcctcggcaaggggtggcccctgtccaagatggacatcggcgtgccgctgctcgccatcgggtgctacagccaggtcaaccccatcaccctgaccgccgcgctgttcctcctggtggcccactacgccatcatcggccccgggctgcaggccaaggccacccgggaggcgcagaagcgcgccgccgccggcatcatgaagaaccccacggtggacggcatcaccgtcatcgacctcgacccgatcccctacgaccccaagttcgagaagcagctgggccaggtgatgctgctcgtgctgtgcgtcacccaggtgctgatgatgcggaccacgtgggccctctgcgaggcgctgaccctggccaccggccccatctccaccctctgggaggggaacccgggccgcttctggaacacgaccatcgccgtgagcatggccaacatcttccgcgggtcctacctggccggcgcgggcctcctgttcagcatcatgaagaacaccaccaacacgcggcgcgggaccggcaacatcggggagaccctgggcgagaagtggaagtcccggctgaacgccctcggcaagagcgagttccagatctacaagaagtccgggatccaggaggtcgaccgcaccctggccaaggagggcatcaagcgcggggagacggaccaccacgccgtgagccgcggctccgcgaagctgcggtggttcgtggagcgcaacctcgtcacccccgaggggaaggtggtggacctgggctgcggccgcggcgggtggagctactactgcggcgggctgaagaacgtccgcgaggtgaaggggctcaccaagggcgggcccgggcacgaggagcccatcccgatgtccacctacggctggaacctggtgcggctgcagagcggggtcgacgtgttcttcacgccgcccgagaagtgcgacaccctcctgtgcgacatcggcgagagctcccccaacccgaccgtggaggccgggcgcaccctgcgggtcctcaacctggtggagaactggctgaacaacaacacccagttctgcatcaaggtgctcaacccctacatgcccagcgtcatcgagaagatggaggccctgcagcgcaagtacggcggcgccctggtgcggaacccgctgtcccgcaacagcacgcacgagatgtactgggtgtccaacgccagcgggaacatcgtctccagcgtgaacatgatctcccggatgctcatcaaccgcttcaccatgcggcacaagaaggcgacctacgagcccgacgtggacctgggcagcgggacccgcaacatcggcatcgagtccgagatccccaacctggacatcatcgggaagcgcatcgagaagatcaagcaggagcacgagacgagctggcactacgaccaggaccacccctacaagacctgggcctaccacggctcctacgagaccaagcagaccggcagcgcctccagcatggtcaacggggtggtgcggctcctgacgaagccgtgggacgtcgtgcccatggtgacccagatggccatgaccgacaccacgcccttcggccagcagcgcgtcttcaaggagaaggtggacacccggacccaggagcccaaggaggggaccaagaagctgatgaagatcacggccgagtggctctggaaggagctgggcaagaagaagaccccgcgcatgtgcacccgggaggagttcacccgcaaggtgcggtccaacgcggccctgggcgccatcttcacggacgagaacaagtggaagtccgcccgcgaggccgtcgaggactcccggttctgggagctcgtggacaaggagcgcaacctgcacctggaggggaagtgcgagacctgcgtctacaacatgatgggcaagcgggagaagaagctcggggagttcggcaaggcgaaggggagccgcgccatctggtacatgtggctgggcgcccggttcctggagttcgaggccctcggcttcctgaacgaggaccactggttcagccgcgagaactccctgagcggggtggagggcgaggggctccacaagctgggctacatcctgcgggacgtgtccaagaaggagggcggggcgatgtacgccgacgacaccgccggctgggacacccgcatcacgctcgaggacctgaagaacgaggagatggtcaccaaccacatggagggggagcacaagaagctggccgaggccatcttcaagctcacctaccagaacaaggtggtgcgggtccagcgccccacgccccggggcacggtgatggacatcatcagccgccgggaccagcgcgggtccggccaggtggggacctacggcctgaacaccttcaccaacatggaggcgcagctgatccgccagatggagggcgagggggtcttcaagagcatccagcacctcacggtgaccgaggagatcgccgtgcagaactggctggcccgggtcggccgcgagcggctgtcccgcatggccatcagcggggacgactgcgtggtgaagcccctcgacgaccggttcgcctccgcgctgaccgccctgaacgacatgggcaaggtccgcaaggacatccagcagtgggagccgagccggggctggaacgactggacccaggtgcccttctgctcccaccacttccacgagctcatcatgaaggacgggcgcgtgctggtcgtgccctgccggaaccaggacgagctgatcggccgcgcccggatcagccagggggccggctggtccctccgcgagacggcctgcctgggcaagagctacgcgcagatgtggtccctgatgtacttccaccggcgcgacctccggctggccgccaacgccatctgcagcgccgtgccctcccactgggtcccgaccagccgcaccacctggagcatccacgcgaagcacgagtggatgaccacggaggacatgctgaccgtgtggaaccgggtgtggatccaggagaacccctggatggaggacaagacccccgtcgagtcctgggaggagatcccctacctcggcaagcgcgaggaccagtggtgcggcagcctgatcgggctgacctcccgggtgacgtggggcaagaacatccagaccgccatcaaccaggtgcgcagcctcatcgggaacgaggagtacaccgactacatgccgtccatgaagcgcttccggcgcgaggaggaggaggccggcgtcctgtggtga

SEQ ID NO: 9633 - RNA, 9876 nt, synthetic construct
  misc_feature 1..9876: note = derived and/or modified CDS sequence (opt1) from DENV-2__FM210215__SS-prME
  source 1..9876: mol_type = other RNA
agcgcggggatgatcgtgatgctgatccccaccgtgatggccttccacctcaccacccgcaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtcacctacgggacctgcaccaccaccggcgagcaccgccgggagaagcgcagcgtggccctggtgccccacgtcgggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtgctcatcttcatcctgctgacggccgtggccccctccatgaccatgcggtgcatcggcatcagcaaccgcgacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcggcctgttcggcaagggcgggatcgtgacgtgcgccatgttcacgtgcaagaagaacatggagggcaagatcgtgcagcccgagaacctggagtacaccatcgtcgtgacgccccactccggggaggagcacgcggtgggcaacgacacggggaagcacggcaaggagatcaaggtcaccccgcagagctccatcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgccggccacggccaggtggacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtcacgatcatggccatcctgtgcgtgccgaacgccgtggtcctccagaacgcctggaaggtgagctgcaccatcctggcggtggtctccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtctccatcctggccagctccctcctgaagaacgacatccccatgaccggccccctggtggccgggggcctcctgaccgtgtgctacgtcctgaccgggcgcagcgccgacctcgagctggagaaggccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtgatctccggcctgttcccgatcagcatccccatcaccgccgccgcctggtacctgtgggaggtcaagaagcagcgcgccggggtgctctgggacgtgcccagcccgccgcccatgggcaaggcggagctggaggacggggcctaccggatcaagcagaagggcatcctggggtacagccagatcggcgccggcgtctacaaggaggggaccttccacaccatgtggcacgtgacccgcggcgccgtgctcatgcacaaggggaagcggatcgagccctcctgggccgacgtcaagaaggacctgatcagctacggcgggggctggaagctggagggcgagtggaaggagggggaggaggtccaggtgctcgcgctggagcccggcaagaacccccgcgccgtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccggtccggcgcctacgtcagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtggtcgccgccgagatggaggaggccctgcgcggcctgcccatccggtaccagacccccgccatcaaggcggagcacacggggcgcgagatcgtggacctcatgtgccacgccaccttcaccatgcggctgctgagccccgtgcgcgtcccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtctggttcgtgccgagcatcaaggcggggaacgacatcgccgcctgcctgcggaagaacggcaagaaggtgatccagctgtcccgcaagaccttcgacagcgagtacgtcaagacccggaccaacgactgggacttcgtggtgacgaccgacatctccgagatgggcgccaacttcaaggcggagcgcgtcatcgacccccggcgctgcatgaagcccgtgatcctcaccgacggggaggagcgggtgatcctggccggccccatgccggtcacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccggaagaccttcgtggacctcatgcgccgcggcgacctgcccgtctggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtcaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtggtcatcgccatcctgaccgtggtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtcgccaccaccttcgtgacgcccatgctgcggcacagcatcgagaacagctccgtgaacgtcagcctcaccgccatcgccaaccaggccaccgtgctgatgggcctggggaagggctggcccctctccaagatggacatcggggtgccgctgctggcgatcggctgctacagccaggtcaaccccatcaccctcacggccgccctgctgctcctggtggcccactacgcgatcatcgggcccggcctgcaggccaaggccacccgcgaggcccagaagcgggccgcggccggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctgttcagcatcatgaagaacacgaccaacacccggcgcggcaccgggaacatcggcgagacgctgggcgagaagtggaagtcccggctgaacagcctcgggaagtccgagttccagatctacaagaagtccggcatccaggaggtggaccgcaccctggccaaggaggggatcaagcgcggcgagaccgaccaccacgcggtctcccgggggagcgccaagctgcgctggttcgtggagcggaacatggtgacccccgagggcaaggtcgtggacctcggctgcgggcgcggcgggtggtcctactactgcggcgggctcaagagcgtgcgggaggtcaagggcctgacgaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgaccgtggaggccggccggacgctgcgcgtgctgaacctcgtcgagaactggctgaacaacaacacccagttctgcatcaaggtgctgaacccctacatgcccagcgtgatcgagaagatggaggccctgcagcggaagtacggcggggcgctcgtccgcaacccgctgtcccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcggctgctcaccaagccgtgggacgtgctgcccaccgtcacccagatggcgatgacggacaccacccccttcgggcagcagcgcgtgttcaaggagaaggtggacacccggacgcaggagcccaaggagggcaccaagaagctgatgaagatcaccgccgagtggctctggaaggagctgggcaagaagaagaccccgcgcatgtgcacgcgcgaggagttcacccggaaggtccgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgagcggcgtggagggggagggcctccacaagctggggtacatcctgcgcgacgtctccaagaaggagggcggcgccatgtacgccgacgacacggccgggtgggacacccggatcaccctcgaggacctgaagaacgaggagatggtgaccaaccacatggagggcgagcacaagaagctggcggaggccatcttcaagctcacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggtcgccgtgcagaactggctggcccgggtggggcgcgagcggctgagccgcatggcgatctccggcgacgactgcgtcgtgaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgccacctgggccaagaacatccaggcggccatcaaccaggtgcggagcctcatcgggaacgaggagtacaccgactacatgccgtccatgaagcgcttccggcgcgaggaggaggaggccggcgtcctgtggtga

SEQ ID NO: 9634 - RNA, 9876 nt, synthetic construct
  misc_feature 1..9876: note = derived and/or modified CDS sequence (opt1) from DENV-2__FM210216__SS-prME
  source 1..9876: mol_type = other RNA
agcgccgggatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtcttcaccacgaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcaccacggtgatcgtcaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacgcgcgtggggaccaagcacgccatcctcctggtcgcggtgtccttcgtgaccctgatcaccggcaacatgagcttcaaggacctcgggcgggtcgtggtgatggtcggcgccacgatggccgacgacatcgggatgggcgtgacctacctggccctgctcgccgcgttcaaggtgcgccccaccttcgccgccggcctgctgctccggaagctgacctccaaggagctgatgatgacgaccatcgggatcgtcctcctgagccagtccaccatccccgagaccgtgctggagctcacggacgccctggccctgggcatgatggtgctcaagatcgtccgcaacatggagaagtaccagctggcggtgaccatcatggccatcctgtgcgtcccgaacgccgtgatcctccagaacgcctggaaggtgagctgcaccatcctggccgtcgtgtccgtgagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtcggcatggtgtccatcctggcgagctccctcctgaagaacgacatccccatgaccggccccctggtggccgggggcctcctgaccgtctgctacgtgctgacggggcgcagcgccgacctcgagctggagcgggccaccgacgtgaagtgggaggaccaggccgagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgcggccgcctggtacctgtgggaggtgaagaagcagcgggccggggtgctctgggacgtccccagcccgccgcccatgggcaaggccgagctggaggacggggcgtaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcccagaccgagaagtccatcgaggacaaccccgagatcgaggacgacatcttccggaagcgccggctgacgatcatggacctgcaccccggggcgggcaagaccaagcgctacctccccgccatcgtgcgggaggccatcaagcgcgggctgcggaccctgatcctcgccccgacccgcgtcgtggcggccgagatggaggaggccctgcggggcctgcccatccgctaccagacgcccgccatccgggccgagcacaccgggcgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggccgggaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggcgccaacttcaaggccgagcgcgtgatcgacccccggcgctgcatgaagcccgtgatcctcaccgacggggaggagcgggtcatcctggcgggccccatgccggtgacgcacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccgcaagaccttcgtcgacctcatgcggcgcggcgacctgcccgtgtggctggcctacaaggtggccgccgaggggatcaactacgcggaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgccggccgcaagagcctgacgctcaacctgatcaccgagatgggccggctgcccaccttcatgacccagaagacgcgcgacgcgctcgacaacctggccgtcctgcacaccgccgaggccgggggccgggcgtacaaccacgccctctccgagctgcccgagaccctggagaccctcctgctgctcacgctgctggccaccgtgaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccaccatggcgaacgagatgggcttcctggagaagacgaagaaggacctcgggctgggctccatcgccacccagcagccggagagcaacatcctggacatcgacctccgccccgcctccgcctggaccctgtacgccgtggcgaccacgttcgtgacccccatgctgcggcacagcatcgagaacagctccgtcaacgtgagcctcaccgccatcgccaaccaggccaccgtgctgatgggcctggggaagggctggcccctctccaagatggacatcggggtcccgctgctggccatcggctgctacagccaggtgaaccccatcacgctcaccgcggccctgctgctcctggtggcccactacgccatcatcgggcccggcctgcaggcgaaggccacccgcgaggcccagaagcgggccgccgcgggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcaacccggggcggttctggaacaccacgatcgccgtgagcatggcgaacatcttccgcggctcctacctggccggcgccgggctcctcttcagcatcatgaagaacaccaccaacacccggcgcggcacggggaacatcggcgagaccctgggcgagaagtggaagtcccgcctgaacgccctcgggaagtccgagttccagatctacaagaagtccggcatccaggaggtcgaccggaccctggccaaggaggggatcaagcgcggcgagaccgaccaccacgcggtgagccgggggtccgccaagctgcgctggttcgtggagcggaacatggtcacgcccgagggcaaggtggtggacctcggctgcgggcgcggcgggtggagctactactgcggcgggctgaagaacgtccgggaggtgaagggcctgaccaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgacggtggaggccggccggaccctgcgcgtcctgaacctcgtggagaactggctgaacaacaacacccagttctgcatcaaggtgctgaacccctacatgccctccgtcatcgagaagatggaggccctgcagcggaagtacggcggggcgctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacgtacgagcccgacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtcaacggcgtggtgcggctgctcaccaagccgtgggacgtcctgcccaccgtgacgcagatggcgatgaccgacaccacccccttcgggcagcagcgcgtgttcaaggagaaggtcgacacgcgcacccaggagcccaaggagggcaccaagaagctgatgaagatcaccgccgagtggctctggaaggagctgggcaagaagaagacgccgcggatgtgcacccgcgaggagttcacccggaaggtgcgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtcgtgcgcgtgcagcggcccacgccccgggggaccgtcatggacatcatcagccggcgcgaccagcggggctccggccaggtggggacgtacggcctgaacaccttcaccaacatggaggcccagctgatccgccagatggagggggagggcgtgttcaagaacatccagcacctcaccgtcacggaggaggtggccgtgcagaactggctggcccgggtcgggcgcgagcgcctgagccggatggcgatctccggcgacgactgcgtggtgaagcccctcgacgaccgcttcgccaacgccctgaccgccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccgcgagaacccctggatggaggacaagacccccgtggagagctgggaggagatcccctacctcggcaagcgggaggaccagtggtgcgggtccctgatcggcctgaccagccgcgccacctgggccaagaacatccaggcggccatcaaccaggtccggtccctcatcgggaacgaggagtacacggactacatgccgagcatgaagcgcttccggcgcgaggaggaggaggccggcgtgctgtggtga

SEQ ID NO: 9635 - RNA, 9876 nt, synthetic construct
  misc_feature 1..9876: note = derived and/or modified CDS sequence (opt1) from DENV-2__FM210217__SS-prME
  source 1..9876: mol_type = other RNA
accgccggcgtgatcatcatgctgatccccaccgccatggcgttccacctcaccacccggaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgaccaccggcgcgagaagcggtccgtcgccctggtgccccacgtggggatgggcctcgagacccggaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcgccgtgagcttcgtgaccctgatcacggggaacatgtccttccgggacctgggccgcgtcatggtgatggtgggggccgcgatgaccgacgacatcggcatcggcgtcacctacctcgccctgctggccgccttcaaggtgcgccccaccttcgccgcggggctcctgctgcggaagctcacgagcaaggagctgatgatggccaccatcggcatcgccctgctctcccagagcaccatcccggagaccatcctggagctgacggacgccctcgccctggggatgatggtgctgaagatcgtccgcaacatggagaagtaccagctcgcggtgaccatcatggccatctcctgcgtgcccaacgccgtcatcctgcagaacgcctggaaggtgagctgcaccatcctggcgaccgtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagcaaggaccccttcccccagtccaacgcccccatcatggacgaggagcgcgagatccccgagcggagctggaactccggccacgagtgggtgacggacttcaaggggaagaccgtctggttcgtgcccagcatcaaggccggcaacgacatcgccgcctgcctgcgcaagaacggcaagaaggtgatccagctctcccggaagaccttcgacagcgagtacgtcaagacccgcacgaacgactgggacttcgtggtgaccaccgacatctccgagatgggggcgaacttcaaggccgagcgggtcatcgacccccgccggtgcatgaagcccgtgatcctgaccgacggcgaggagcgcgtgatcctggccgggccgatgcccgtcacgcacagctccgccgcccagcggcgcggccggatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgcgagaaggtggacgccatcgacggggagtaccggctccgcggcgaggcccggaagaccttcgtggacctgatgcgccgcggggacctgccggtctggctcgcctaccgcgtggcggccgagggcatcaactacgccgaccggcgctggtgcttcgacggggtgaagaacaaccagatcctggaggagaacgtcgaggtggagatctggaccaaggagggcgagcggaagaagctgaagccccgctggctcgacgcccggatctactccgaccccctggcgctgaaggagttcaaggagttcgccgccggccgcaagagcctcacgctgaacctgatcaccgagatggggcggctccccaccttcatgacccagaaggcccgcgacgccctggacaacctggcggtgctccacacggccgaggccggcgggcgggcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggcacgcccagatccagccccactggatcgccgccagcatcatcctcgagttcttcctgatcgtcctgctcatccccgagcccgagaagcagcgcaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcggcccgcgagcgcctggaccctgtacgccgtggccaccaccttcgtcacgcccatgctccgccactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgggaggcgcagaagcgcgccgccgccgggatcatgaagaacccgaccgtggacggcatcaccgtgatcgacctggaccccatcccctacgaccccaagttcgagaagcagctggggcaggtcatgctcctgatcctgtgcgtgacccaggtgctcatgatgcggaccacctgggccctgtgcgaggcgctgaccctcgccacgggcccgatctccaccctgtgggaggggaaccccggccgcttctggaacaccaccatcgccgtcagcatggccaacatcttccgcggctcctacctggcgggggccggcctcctgttcagcatcatgaagaacacgaccaacacccggcgcgggaccggcaacatcggcgagacgctgggggagaagtggaagtcccggctcaacgccctgggcaagagcgagttccagatctacaagaagtccgggatccaggaggtggaccgcaccctggccaaggagggcatcaagcgcggggagaccgaccaccacgccgtgagccgcggctccgcgaagctccggtggttcgtcgagcgcaacatggtgacccccgagggcaaggtggtcgacctggggtgcggccgcgggggctggagctactactgcgggggcctgaagaacgtgcgcgaggtgaagggcctcacgaagggcggccccgggcacgaggagccgatccccatgtccacctacggctggaacctggtccggctgcagagcggggtggacgtgttcttcacgccgcccgagaagtgcgacaccctcctgtgcgacatcggcgagtccagcccgaaccccacgatcgaggccggccgcaccctgcgggtcctcagcctggtggagaactggctgaacaacgacacccagttctgcatcaaggtgctcaacccctacatgccgtccgtcatcgagaagatggagaccctgcagcgcaagtacgggggcgccctggtgcggaaccccctgagccgcaactccacccacgagatgtactgggtgagcaacgccacggggaacatcgtctccagcgtgaacatgatctcccggatgctcatcaaccgcttcaccatgaagcacaagaaggccacctacgagcccgacgtggacctgggcagcgggacccggaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtcaacggggtggtgcgcctcctgacgaagccctgggacgtcgtgcccatggtgacccagatggccatgaccgacaccacgcccttcggccagcagcgggtcttcaaggagaaggtggacacccgcacccaggagccgaaggagggcaccaagaagctgatgaagatcacggccgagtggctctggaaggagctggggaagaagaagacgccccggatgtgcacccgcgaggagttcacccggaaggtgcgctccaacgccgcgctgggcgccatcttcacggacgagaacaagtggaagtccgcccgggaggccgtcgaggactcccgcttctgggagctcgtggacaaggagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggagaacagcctgagcggggtcgagggcgaggggctccacaagctgggctacatcctgcgcgacgtgtccaagaaggagggcggggccatgtacgcggacgacaccgccggctgggacacccggatcacgctcgaggacctgaagaacgaggagatggtcaccaaccacatggagggggagcacaagaagctggccgaggccatcttcaagctcacctaccagaacaaggtggtgcgcgtccagcggcccacgccccggggcacggtgatggacatcatcagccggcgcgaccagcgggggtccggccaggtgggcacctacgggctgaacaccttcaccaacatggaggcccagctgatccgccagatggagggcgaggggatcttcaagagcatccagcacctcacggcgaccgaggagatcgccgtccagaactggctggcccgcgtgggccgggagcgcctgtcccggatggccatcagcggcgacgactgcgtggtcaagccgctcgacgaccgcttcgcctccgcgctgaccgccctgaacgacatggggaaggtgcggaaggacatccagcagtgggagcccagccgcggctggaacgactggacccaggtgcccttctgctcccaccacttccacgagctcatcatgaaggacgggcgggtcctggtggtgccctgccgcaaccaggacgagctgatcggccgggcccgcatcagccagggggccggctggtccctcaaggagacggcctgcctgggcaagagctacgcgcagatgtggtccctgatgtacttccaccggcgcgacctccggctggccgccaacgccatctgcagcgcggtcccgtcccactgggtgcccaccagccgcaccacctggtccatccacgccaagcacgagtggatgaccacggaggacatgctgaccgtgtggaaccgggtctggatccaggagaacccctggatggaggacaagacccccgtggagagctgggaggaggtgccgtacctcgggaagcgcgaggaccagtggtgcggcagcctgatcgggctgacctcccgggccacgtgggccaagaacatccagaccgccatcaaccaggtccgcagcctcatcggcaacgaggagtacaccgactacatgccctccatgaagcggttccgccgcgaggaggaggaggcgggggtgctgtggtga

SEQ ID NO: 9636 - RNA, 9876 nt, synthetic construct
  misc_feature 1..9876: note = derived and/or modified CDS sequence (opt1) from DENV-2__JX286524__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagtccttcgccgggcccgtgagccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggcctccgggaagctcatcaccgagtggtgctgccggagctgcaccctgcccccgctgcgctaccggggcgaggacgggtgctggtacggcatggagatccgccccctcaaggagaaggaggagaacctggtcaactccctggtgaccgccgggcacggccagatcgacaacttcagcctcggcgtgctggggatggccctgttcctcgaggagatgctgcggacgcgcgtcggcaccaagcacgcgatcctgctcgtggccctgtccttcgtgaccctgatcaccgggaacatgagcttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgtccaaggagctgatgatggccaccatcggcatcgccctcctgagccagtccaccctgcccgagaccatcctcgagctgacggacgcgctggccctcgggatgatggccctgaagatcgtgcgcaacatggagaagtaccagctggccgtcaccatcatggccatcagctgcgtgccgaacgcggtgatcctccagaacgcctggaaggtctcctgcaccatcctggccgccgtgagcgtgagccccctgctcctgaccagctcccagcagaaggcggactggatccccctggccctcacgatcaagggcctgaaccccaccgccatcttcctgaccaccctcagccggacgtccaagaagcgcagctggccgctgaacgaggccatcatggccgtcggcatggtgtccatcctggcgagcagcctcctgaagaacgacatccccatgaccgggcccctggtcgccggcgggctcctgaccgtgtgctacgtgctgaccggccggtccgccgacctcgagctggagcgcgccgccgacgtcaagtgggaggaccaggcggagatcagcgggtccagccccatcctgtccatcacgatcagcgaggacggctccatgagcatcaagaacgaggaggaggagcagaccctcaccatcctgatccggaccggcctgctcgtgatctccggggtgttcccggtcagcatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctacagccagatcggcgccggggtgtacaaggagggcacgttccacaccatgtggcacgtcacccgcggggccgtgctgatgcaccgcggcaagcggatcgagccctcctgggccgacgtgaagaaggacctcatcagctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtctccctggacttcagccccggcacctccgggagccccatcgtggaccggaagggcaaggtggtcgggctgtacggcaacggcgtggtgacgcgctccggggcctacgtcagcgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctctcccccgtgcgcgtcccgaactacaacctgatcatcatggacgaggcccacttcaccgaccccgccagcatcgccgcgcggggctacatctccacccgcgtggagatgggggaggccgccggcatcttcatgacggccacgccgcccgggagccgggacccgttcccccagtccaacgcgcccatcatggacgaggagcgcgagatccccgagcggagctggaactccggccacgagtgggtgaccgacttcaaggggaagaccgtctggttcgtgccgagcatcaaggccggcaacgacatcgccgcctgcctgcgcaagaacggcaagaaggtgatccagctctcccggaagacgttcgacagcgagtacgtcaagacccgcgccaacgactgggacttcgtggtgaccaccgacatctccgagatgggggcgaacttcaaggccgagcgggtcatcgacccccgccggtgcatgaagcccgtgatcctgacggacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctactccgaccccctggcgctgaaggagttcaaggagttcgccgccggccgcaagagcctcaccctgaacctgatcaccgagatggggcggctccccaccttcatgacgcagaaggcccgcaacgccctggacaacctggcggtgctccacaccgccgaggtgggcgggaaggcctacacccacgccctgtccgagctgcccgagaccctcgagacgctgctgctcctgaccctgctcgccgcggtcaccggcggcatcttcctgttcctgatgagcgggaagggcatcgggaagatgaccctcggcatgtgctgcatcatcaccgcctccatcctgctgtggtacgcccagatccagccgcactggatcgccgccagcatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagtccgagagcaacatcctggacatcgacctccgcccggcctccgcgtggaccctgtacgccgtggccacgaccttcgtgacccccatgctgcggcacagcatcgagaactccagcgtcaacgtgtccctcaccgccatcgcgaaccaggccacggtgctgatggggctgggcaaggggtggcccctcagcaagatggacatcggcgtccccctgctggccatcgggtgctactcccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatcagcaccctctgggaggggaaccccggccggttctggaacacgaccatcgccgtgtccatggccaacatcttccgcggcagctacctggccggggcgggcctcctgttctccatcatgaagaacaccaccaacacgcgccgggggaccggcaacgtcggcgagaccctgggggagaagtggaagtcccgcctgaacgccctcggcaagtccgagttccagatctacaagaagtccgggatccaggaggtggaccggaccctggccaaggagggcatcaagcgcggggagacggaccaccacgccgtgtcccggggcagcgccaagctgcgctggttcgtcgagcggaacatggtgaccccggagggcaaggtggtcgacctcgggtgcggccgcgggggctggtcctactactgcgggggcctgaagaacgtgcgggaggtgaagggcctgaccaagggcgggcccgggcacgaggagcccatccccatgagcacctacggctggaacctcgtccgcctgcagagcggggtggacgtgttcttcacgccgcccgagaagtgcgacaccctgctctgcgacatcggcgagtccagccccaaccccaccatcgaggcgggccggaccctgcgcgtcctgaacctcgtggagaactggctgaacaacaacacccagttctgcatcaaggtgctgaacccgtacatgccctccgtcatcgagaagatggagacgctccagcggaagtacgggggcgccctggtgcgcaaccccctgagccggaactccacccacgagatgtactgggtgagcaacgccaccgggaacatcgtctccagcgtgaacatgatctcccgcatgctgatcaaccggttcaccatgaagcacaagaaggccacgtacgagccggacgtggacctcggcagcgggacccgcaacatcggcatcgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcgtccagcatggtcaacggggtggtgcgcctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtgcggtccaacgccgccctgggcgcggtcttcaccgacgagaacaagtggaagtccgcccgcgaggccgtggaggacgggcggttctgggagctggtggaccgcgagcggaacctccacctggagggcaagtgcgagacctgcgtctacaacatgatggggaagcgcgagaagaagctgggcgagttcggcaaggccaaggggtcccgggcgatctggtacatgtggctcggcgcccgcttcctggagttcgaggccctggggttcctcaacgaggaccactggttcagccggggcaacagcctgtccggggtggagggcgagggcctgcaccgcctcgggtacatcctgcgggaggtcggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccggggcaccgtgatggacatcatcagccgcaaggaccagcgggggtccggccaggtcgggacctacggcctcaacacgttcaccaacatggaggcccagctgatccgccagatggagggcgaggggatcttcaagagcatccagcacctgaccgccaccgaggagatcgcggtgcagaactggctcgcccgcgtgggccgggagcgcctgtcccggatggccatcagcggggacgactgcgtcgtgaagcccatcgacgaccgcttcgcctccgccctgacggcgctcaacgacatgggcaaggtgcggaaggacatccagcagtgggagcccagccgcgggtggaacgactggacccaggtcccgttctgctcccaccacttccacgagctggtgatgaaggacggccgggtgctggtcgtgccctgccgcaaccaggacgagctcatcggccgggcccgcatcagccagggggccggctggtccctgaaggagaccgcctgcctgggcaagagctacgcccagatgtggaccctcatgtacttccaccggcgcgacctgcggctggcggccaacgccatctgctccgccgtgcccagccactgggtccccacctcccgcacgacctggagcatccacgcgaagcacgagtggatgaccaccgaggacatgctcgccgtgtggaaccgggtgtggatccaggagaacccgtggatggaggacaagacgcccgtcgagtcctgggaggaggtgccctacctgggcaagcgcgaggaccagtggtgcgggagcctgatcggcctcaccagccgggccacctgggccaagaacatccagaccgccatcaaccaggtgcgctccctgatcggcaacgaggggtacacggactacatgcccagcatgaagcggttccgccgcgaggaggaggaggcgggcgtcctgtggtga

SEQ ID NO: 9637 - RNA, 9876 nt, synthetic construct
  misc_feature 1..9876: note = derived and/or modified CDS sequence (opt1) from DENV-2__JX286520__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcatcgtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcgtgggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcatcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccctgagcttcgtgaccctgatcaccgggaacatgtccttccgggacctcggccgcgtcatggtgatggtgggggccaccatgacggacgacatcggcatgggcgtcacctacctggccctgctcgccgcgttcaaggtgcgccccaccttcgccgccgggctgctgctccggaagctgaccagcaaggagctgatgatggccacgatcggcatcgccctcctgtcccagagcaccctgcccgagaccatcctcgagctgaccgacgcgctggccctcgggatgatggccctgaagatcgtgcgcaacatggagaagtaccagctggccgtcacgatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcaccatcaagggcctgaaccccacggccatcttcctgaccaccctctcccggaccagcaagaagcgctcctggccgctgaacgaggccatcatggccgtcggcatggtgagcatcctggcgtccagcctcctgaagaacgacatccccatgacggggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcaccatctccgaggacggcagcatgtccatcaagaacgaggaggaggagcagacgctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcaccttccacacgatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagaccaacacggggaccatcggcgccgtcagcctggacttctcccccggcaccagcgggtcccccatcgtggaccggaagggcaaggtggtcgggctgtacggcaacggcgtggtgacccgcagcggggcctacgtctccgcgatcgcccagacggagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcaccctcatcctggcgccgacgcgcgtggtcgccgccgagatggaggaggccctgcgggggctccccatccgctaccagacccccgccatccgggcggagcacaccggccgcgagatcgtggacctgatgtgccacgccaccttcacgatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagaccttcgactccgagtacgtcaagacgcgcgccaacgactgggacttcgtggtgaccaccgacatcagcgagatgggggcgaacttcaaggccgagcgggtcatcgacccccgccggtgcatgaagcccgtgatcctgaccgacggcgaggagcgcgtgatcctggccgggcccatgccggtcacgcactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggaccaaggagggcgagcggaagaagctgaagccgcgctggctcgacgcccggatctacagcgaccccctggcgctgaaggagttcaaggagttcgccgccggccgcaagtccctcacgctgaacctgatcaccgagatggggcggctccccaccttcatgacccagaaggcccgcaacgccctggacaacctggcggtgctccacacggccgaggtgggcgggaaggcctacacccacgccctgagcgagctgcccgagaccctcgagaccctgctgctcctgacgctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacgtacgtcgtgatcgcgatcctgaccgtggtcgccgccaccatggccaacgagatggggttcctcgagaagaccaagaaggacttcggcttcggcagcatcacgacccaggagagcgagtccaacatcctggacatcgacctgcgcccggccagcgcgtggaccctctacgccgtggccaccacgttcgtgacccccatgctgcggcactccatcgagaacagctccgtcaacgtgagcctgaccgccatcgcgaaccaggccaccgtgctcatggggctgggcaaggggtggcccctgtccaagatggacatcggcgtccccctcctggccatcgggtgctacagccaggtgaacccgatcacgctgaccgccgccctcctgctgctcgtggcgcactacgccatcatcggccccggcctgcaggccaaggccacccgcgaggcccagaagcgggcggccgccgggatcatgaagaaccccaccgtcgacggcatcacggtgatcgacctggagcccatcccgtacgaccccaagttcgagaagcagctcgggcaggtcatgctgctgatcctctgcgtcacccaggtgctgatgatgcgcaccacctgggccctgtgcgaggccctcacgctggcgaccggccccatctccaccctgtgggaggggaaccccggccggttctggaacaccacgatcgccgtgagcatggccaacatcttccgcggctcctacctcgccggggcgggcctgctgttcagcatcatgaagaacaccaccaacacccgccgggggacgggcaacgtcggcgagaccctcggggagaagtggaagtcccgcctgaacgccctgggcaagagcgagttccagatctacaagaagtccgggatccaggaggtggaccggaccctcgccaaggagggcatcaagcgcggggagaccgaccaccacgccgtgagccggggctccgccaagctgcgctggttcgtcgagcggaacatggtgacgccggagggcaaggtggtcgacctggggtgcggccgcgggggctggagctactactgcgggggcctcaagaacgtgcgggaggtgaagggcctgaccaagggcggccccgggcacgaggagcccatccccatgtccacctacggctggaacctggtccgcctccagagcggggtggacgtgttcttcaccccgcccgagaagtgcgacacgctgctgtgcgacatcggcgagagctcccccaaccccaccatcgaggcgggccggaccctccgcgtcctgaacctggtggagaactggctcaacaacaacacccagttctgcatcaaggtgctgaacccgtacatgcccagcgtcatcgagaagatggagaccctgcagcggaagtacgggggcgccctcgtgcgcaaccccctgtcccggaacagcacgcacgagatgtactgggtgtccaacgccaccgggaacatcgtcagctccgtgaacatgatcagccgcatgctgatcaaccggttcaccatgaagcacaagaaggccacctacgagccggacgtggacctgggctccgggacgcgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagaccaagcagacgggctccgcgagctccatggtcaacggggtggtgcgcctgctgaccaagccctgggacgtcgtgccgatggtgacccagatggccatgaccgacacgacccccttcggccagcagcgcgtcttcaaggagaaggtggacacccggacccaggagcccaaggagggcacgaagaagctcatgaagatcaccgccgagtggctgtggaaggagctggggaaggagaagacgccccggatgtgcacccgggaggagttcacgcgcaaggtgcggagcaacgccgccctcggcgcggtcttcaccgacgagaacaagtggaagtccgcccgcgaggccgtggaggacgggcggttctgggagctggtggaccgcgagcggaacctgcacctcgagggcaagtgcgagacctgcgtctacaacatgatggggaagcgcgagaagaagctgggcgagttcggcaaggccaaggggagccgggcgatctggtacatgtggctgggcgcccgcttcctcgagttcgaggccctggggttcctgaacgaggaccactggttctcccggggcaacagcctcagcggggtggagggcgagggcctgcaccgcctggggtacatcctccgggaggtcggcaagaaggagggcggcgccatgtacgccgacgacaccgcggggtgggacacgcgcatcaccctggaggacctgaagaacgaggagatggtgaccaaccacatgaagggcgagcacaagaagctcgccgaggccatcttcaagctgacctaccagaacaaggtggtccgggtgcagcgcccgacgccccggggcaccgtgatggacatcatctcccgcaaggaccagcgggggagcggccaggtcgggacctacggcctgaacaccttcacgaacatggaggcccagctcatccgccagatggagggcgaggggatcttcaagtccatccagcacctgaccgccaccgaggagatcgcggtgcagaactggctggcccgcgtgggccgggagcgcctcagccggatggccatctccggggacgactgcgtcgtgaagcccatcgacgaccgcttcgccagcgccctgaccgcgctgaacgacatgggcaaggtgcggaaggacatccagcagtgggagccctcccgcgggtggaacgactggacgcaggtcccgttctgcagccaccacttccacgagctcgtgatgaaggacggccgggtgctggtcgtgccctgccgcaaccaggacgagctgatcggccgggcccgcatctcccagggggccggctggagcctcaaggagaccgcctgcctggggaagtcctacgcccagatgtggaccctgatgtacttccaccggcgcgacctccggctggcggccaacgccatctgcagcgccgtgccctcccactgggtccccaccagccgcaccacgtggtccatccacgcgaagcacgagtggatgaccaccgaggacatgctggccgtgtggaaccgggtgtggatccaggagaacccgtggatggaggacaagacccccgtcgagagctgggaggaggtgccctacctcggcaagcgcgaggaccagtggtgcgggtccctgatcggcctgacgagccgggccacctgggccaagaacatccagaccgccatcaaccaggtgcgcagcctcatcggcaacgaggggtacaccgactacatgccctccatgaagcggttccgccgcgaggaggaggaggcgggcgtcctgtggtga

SEQ ID NO: 9638 - RNA, 9876 nt, synthetic construct
  misc_feature 1..9876: note = derived and/or modified CDS sequence (opt1) from DENV-2__JX286525__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagtccttcgccgggcccgtgagccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggcctccgggaagctcatcaccgagtggtgctgccggagctgcaccctgcccccgctgcgctaccggggcgaggacgggtgctggtacggcatggagatccgccccctcaaggagaaggaggagaacctggtcaactccctggtgaccgccgggcacggccagatcgacaacttcagcctcggcgtgctggggatggccctgttcctcgaggagatgctgcggacgcgcgtcggcaccaagcacgcgatcctgctcgtggccctgtccttcgtgaccctgatcaccgggaacatgagcttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgtccaaggagctgatgatggccaccatcggcatcgccctcctgagccagtccaccctgcccgagaccatcctcgagctgacggacgcgctggccctcgggatgatggccctgaagatcgtgcgcaacatggagaagtaccagctggccgtcaccatcatggccatcagctgcgtgccgaacgcggtgatcctccagaacgcctggaaggtctcctgcaccatcctggccgccgtgagcgtgagccccctgctcctgaccagctcccagcagaaggcggactggatccccctggccctcacgatcaagggcctgaaccccaccgccatcttcctgaccaccctcagccggacgtccaagaagcgcagctggccgctgaacgaggccatcatggccgtcggcatggtgtccatcctggcgagcagcctcctgaagaacgacatccccatgaccgggcccctggtcgccggcgggctcctgaccgtgtgctacgtgctgaccggccggtccgccgacctcgagctggagcgcgccgccgacgtcaagtgggaggaccaggcggagatcagcgggtccagccccatcctgtccatcacgatcagcgaggacggctccatgagcatcaagaacgaggaggaggagcagaccctcaccatcctgatccggaccggcctgctcgtgatctccggggtgttcccggtcagcatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctacagccagatcggcgccggggtgtacaaggagggcacgttccacaccatgtggcacgtcacccgcggggccgtgctgatgcaccgcggcaagcggatcgagccctcctgggccgacgtgaagaaggacctcatcagctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtctccctggacttcagccccggcacctccgggagccccatcgtggaccggaagggcaaggtggtcgggctgtacggcaacggcgtggtgacgcgctccggggcctacgtcagcgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctctcccccatccgcgtgccgaactacaacctgatcatcatggacgaggcccacttcaccgaccccgccagcatcgccgcgcggggctacatctccacccgcgtcgagatgggggaggccgccggcatcttcatgacggccacgccgcccgggagccgggacccgttcccccagtccaacgcgcccatcatggacgaggagcgcgagatccccgagcggagctggaactccggccacgagtgggtgaccgacttcaaggggaagaccgtgtggttcgtcccgagcatcaaggccggcaacgacatcgccgcctgcctgcgcaagaacggcaagaaggtgatccagctctcccggaagacgttcgacagcgagtacgtgaagacccgcgccaacgactgggacttcgtcgtgaccaccgacatctccgagatgggggcgaacttcaaggccgagcgggtgatcgacccccgccggtgcatgaagcccgtcatcctgacggacggcgaggagcgcgtgatcctggccgggcccatgccggtgacccacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgcgagaaggtcgacgccatcgacggggagtaccggctccgcggcgaggcccggaagaccttcgtggacctgatgcgccgcggggacctgcccgtgtggctcgcctacaaggtcgcggccgagggcatcaactacgccgaccgcaagtggtgcttcgacgggatcaagaacaaccagatcctggaggagaacgtggaggtggagatctggacgaaggagggcgagcggaagaagctgaagccgcgctggctcgacgcccggatctactccgaccccctggcgctgaaggagttcaaggagttcgccgccggccgcaagagcctcaccctgaacctgatcaccgagatggggcggctccccaccttcatgacgcagaaggcccgcaacgccctggacaacctggcggtcctccacaccgccgaggtgggcgggaaggcctacacccacgccctgtccgagctgcccgagaccctcgagacgctgctgctcctgaccctgctcgccgcggtgaccggcggcatcttcctgttcctgatgagcgggaagggcatcgggaagatgaccctcggcatgtgctgcatcatcaccgcctccatcctgctgtggtacgcccagatccagccgcactggatcgccgccagcatcatcctcgagttcttcctgatcgtcctgctcatccccgagcccgagaagcagcggacgccccaggacaaccagctgacctacgtggtcatcgcgatcctgaccgtggtggccgccaccatggccaacgagatggggttcctcgagaagacgaagaaggacctgggcttcggcagcatcaccacccaggagtccgagagcaacatcctggacatcgacctccgcccggcctccgcgtggaccctgtacgccgtcgccacgaccttcgtgacccccatgctgcggcacagcatcgagaactccagcgtgaacgtctccctcaccgccatcgcgaaccaggccacggtgctgatggggctgggcaaggggtggcccctcagcaagatggacatcggcgtgcccctgctggccatcgggtgctactcccaggtcaacccgatcaccctcaccgccgccctgctgctcctggtggcgcactacgccatcatcggccccggcctgcaggccaaggccacccgcgaggcccagaagcgggcggccgccgggatcatgaagaaccccacggtggacggcatcaccgtcatcgacctcgagcccatcccgtacgaccccaagttcgagaagcagctggggcaggtcatgctgctcatcctgtgcgtgacccaggtcctgatgatgcgcaccacgtgggccctctgcgaggccctgaccctggcgaccggccccatcagcaccctctgggaggggaaccccggccggttctggaacacgaccatcgccgtgtccatggccaacatcttccgcggcagctacctggccggggcgggcctcctgttctccatcatgaagaacaccaccaacacgcgccgggggaccggcaacgtgggcgagaccctgggggagaagtggaagtcccgcctgaacgccctcggcaagtccgagttccagatctacaagaagtccgggatccaggaggtcgaccggaccctggccaaggagggcatcaagcgcggggagacggaccaccacgccgtgtcccggggcagcgccaagctgcgctggttcgtggagcggaacatggtcaccccggagggcaaggtggtggacctcgggtgcggccgcgggggctggtcctactactgcgggggcctgaagaacgtccgggaggtgaagggcctgaccaagggcgggcccgggcacgaggagcccatccccatgagcacctacggctggaacctcgtgcgcctgcagagcggggtcgacgtgttcttcacgccgcccgagaagtgcgacaccctgctctgcgacatcggcgagtccagccccaaccccaccatcgaggcgggccggaccctgcgcgtgctgaacctcgtcgagaactggctgaacaacaacacccagttctgcatcaaggtgctgaacccgtacatgccctccgtgatcgagaagatggagacgctccagcggaagtacgggggcgccctggtccgcaaccccctgagccggaactccacccacgagatgtactgggtgagcaacgccaccgggaacatcgtgtccagcgtcaacatgatctcccgcatgctgatcaaccggttcaccatgaagcacaagaaggccacgtacgagccggacgtggacctcggcagcgggacccgcaacatcggcatcgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcgtccagcatggtgaacggggtcgtgcgcctgctcaccaagccctgggacgtggtcccgatggtgacccagatggccatgacggacaccacccccttcggccagcagcgcgtgttcaaggagaaggtcgacacccggacgcaggagcccaaggagggcaccaagaagctgatgaagatcaccgccgagtggctgtggaaggagctcgggaaggagaagacgccccggatgtgcacgcgggaggagttcacccgcaaggtgcggtccaacgccgccctgggcgcggtgttcaccgacgagaacaagtggaagtccgcccgcgaggccgtcgaggacgggcggttctgggagctggtggaccgcgagcggaacctccacctggagggcaagtgcgagacctgcgtgtacaacatgatggggaagcgcgagaagaagctgggcgagttcggcaaggccaaggggtcccgggcgatctggtacatgtggctcggcgcccgcttcctggagttcgaggccctggggttcctcaacgaggaccactggttcagccggggcaacagcctgtccggggtcgagggcgagggcctgcaccgcctcgggtacatcctgcgggaggtgggcaagaaggagggcggcgccatgtacgccgacgacacggcggggtgggacacccgcatcaccctggaggacctcaagaacgaggagatggtcaccaaccacatgaagggcgagcacaagaagctggccgaggccatcttcaagctgacgtaccagaacaaggtggtgcgggtccagcgcccgacgccccggggcaccgtgatggacatcatcagccgcaaggaccagcgggggtccggccaggtggggacctacggcctcaacacgttcaccaacatggaggcccagctgatccgccagatggagggcgaggggatcttcaagagcatccagcacctgaccgccaccgaggagatcgcggtccagaactggctcgcccgcgtgggccgggagcgcctgtcccggatggccatcagcggggacgactgcgtggtcaagcccatcgacgaccgcttcgcctccgccctgacggcgctcaacgacatgggcaaggtgcggaaggacatccagcagtgggagcccagccgcgggtggaacgactggacccaggtgccgttctgctcccaccacttccacgagctggtcatgaaggacggccgggtgctggtggtcccctgccgcaaccaggacgagctcatcggccgggcccgcatcagccagggggccggctggtccctgaaggagaccgcctgcctgggcaagagctacgcccagatgtggaccctcatgtacttccaccggcgcgacctgcggctggcggccaacgccatctgctccgccgtgcccagccactgggtgcccacctcccgcacgacctggagcatccacgcgaagcacgagtggatgaccaccgaggacatgctcgccgtctggaaccgggtgtggatccaggagaacccgtggatggaggacaagacgcccgtggagtcctgggaggaggtcccctacctgggcaagcgcgaggaccagtggtgcgggagcctgatcggcctcaccagccgggccacctgggccaagaacatccagaccgccatcaaccaggtgcgctccctgatcggcaacgaggggtacacggactacatgcccagcatgaagcggttccgccgcgaggaggaggaggcgggcgtgctgtggtga

SEQ ID NO: 9639 - RNA, 9876 nt, synthetic construct
  misc_feature 1..9876: note = derived and/or modified CDS sequence (opt1) from DENV-2__KM279598__SS-prME
  source 1..9876: mol_type = other RNA
accgcgggcatcatcatcatgatgatccccaccgtgatggccttccacctgaccacccgcaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacgtggggcgcgtgatggtcatggtgggcgccaccatgaccgacgacatcgggatgggcgtgacgtacctcgccctgctggcggccttcaagatccggcccaccttcgccgccggcctcctgctgcgcaagctcacctccaaggagctgatgatgaccacgatcgggatcgtcctgctcagccagtccaccatccccgagagcatcctggagctgaccgacgccctcgcgctgggcatgatggtgctgaagatcgtccggaacatggagaagtaccagctcgccgtgaccatcatggccatcctgtgcgtgcccaacgccgtcatcctgcagaacgcctggaaggtgtcctgcacgaccctcgcggtggtcagcgtgtccccgctgctgctcaccagctcccagcagaaggccgactggatccccctggccctgaccatcaaggggctcaaccccacggccatcttcctgaccaccctgagccgcacctccaagaagcggagctggcccctcaacgaggcgatcatggccgtgggcatggtctccatcctggccagctccctgctcaagaacgacatcccgatgacgggccccctggtggccgggggcctgctcaccgtgtgctacgtcctgaccgggcgcagcgccgacctggagctcgagcgggcggccgacgtgcgctgggaggagcaggccgagatcagcggctccagccccatcctgtccatcaccatcagcgaggacgggtccatgagcatcaagaacgaggaggaggagcagacgctgaccatcctcatccggaccggcctgctggtgatctccggcctcttccccgtcagcatcccgatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtacagccagatcggcgccggcgtgtacaaggaggggaccttccacacgatgtggcacgtcacccgcggcgcggtgctgatgcacaaggggaagcggatcgagccctcctgggccgacgtgaagaaggacctcatcagctacggcgggggctggaagctggagggcgagtggaaggagggggaggaggtccaggtgctggccctcgagcccggcaagaacccccgcgccgtgcagaccaagcccgggctgttcaagaccaacacgggcaccatcggggccgtctccctggacttcagccccggcacctccggcagccccatcgtggacaagaaggggaaggtggtcggcctctacgggaacggcgtggtgacccggtccggcacgtacgtcagcgcgatcgcccagaccgagaagtccatcgaggacaacccggagatcgaggacgacatcttccgcaagaagcggctgaccatcatggacctgcaccccggggccggcaagaccaagcgctacctgcccgccatcgtgcgggaggcgatcaagcgcgggctccggacgctgatcctggcccccacccgcgtggtcgccgccgagatggaggaggccctccgcggcctgccgatccggtaccagacccccgcgatccgcgccgagcacaccgggcgggagatcgtggacctgatgtgccacgccacgttcaccatgcgcctcctgagccccatccgggtgcccaactacaacctgatcatcatggacgaggcccacttcaccgacccggccagcatcgcggcccgcggctacatctccacccgggtcgagatgggcgaggccgccgggatcttcatgacggccacgccgcccggcagccgcgaccccttcccgcagtccaacgcgcccatcatggacgaggagaaggagatccccgagcggagctggaactccgggcacgagtgggtgaccgacttcaagggcaagaccgtgtggttcgtccccagcatcaaggccgggaacgacatcgccgcctgcctccgcaagaacggcaagaaggtgatccagctgtcccggaagacgttcgacagcgagtacatcaagacccgcaccaacgactgggacttcgtggtcaccacggacatctccgagatgggcgcgaacttcaaggccgagcgggtgatcgacccgcgccggtgcatgaagcccgtgatcctgaccgacggggaggagcgcgtcatcctcgccggccccatgcccgtgacccacagctccgccgcccagcggcgcgggcgggtgggccgcaacccgaagaacgagaacgaccagtacatctacatgggggagcccctggagaacgacgaggactgcgcgcactggaaggaggccaagatgctgctcgacaacatcaacacccccgagggcatcatccccagcatgttcgagccggagcgcgagaaggtcgacgccatcgacggcgagtaccggctgcgcggggaggcccggaagacgttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccccgctggctggacgcccggatctactccgacccgctggccctcaaggagttcaaggagttcgcggccggccgcaagagcctgaccctgaacctcatcaccgagatgggccggctgcccacgttcatgacccagaaggccaagaacgccctggacaacctcgcggtgctgcacaccgccgaggccgggggccgcgcctacaaccacgccctgtccgagctccccgagaccctggagacgctgctcctgctgaccctcctggcgaccgtcaccgggggcatcttcctgttcctcatgagcggcaaggggatcggcaagatgaccctggggatgtgctgcatcatcacggcctccatcctgctctggtacgcccagatccagccccactggatcgccgccagcatcatcctggagttcttcctgatcgtgctcctgatcccggagcccgagaagcagcggacgccccaggacaaccagctgacctacgtggtcatcgcgatcctcaccgtggtggccgccacgatggccaacgagatgggcttcctggagaagaccaagaaggacttcgggctgggctccatcaccacccagcagcccgagagcaacatcctcgacatcgacctgcgcccggccagcgcgtggacgctgtacgccgtcgccaccaccttcatcacccccatgctccggcactccatcgagaacagctccgtgaacgtgagcctgacggccatcgccaaccaggcgaccgtcctgatgggcctcgggaagggctggcccctgtccaagatggacatcggggtgcccctgctcgccatcggctgctacagccaggtgaacccgatcaccctgaccgccgccctgctcctgctggtcgcgcactacgccatcatcgggcccggcctccaggccaaggccacgcgcgaggcccagaagcgggcggccgccggcatcatgaagaaccccaccgtggacgggatgaccgtgatcgacctggaccccatcccgtacgaccccaagttcgagaagcagctgggccaggtcatgctcctggtgctgtgcgtgacccaggtcctcatgatgcgcacgacctgggccctgtgcgaggccctgaccctcgcgaccgggcccatctccacgctgtgggagggcaaccccgggcggttctggaacaccaccatcgccgtgagcatggccaacatcttccgcggctcctacctggccggcgccgggctcctgttcagcatcatgaagaacaccgcgaacacgcgccggggcaccgggaacaccggcgagaccctgggcgagaagtggaagaaccgcctcaacgccctggggaagtccgagttccagatctacaagaagtccggcatccaggaggtggaccggacgctggccaaggaggggatcaagcgcggcgagaccgaccaccacgccgtcagccgggggagcgcgaagctccgctggttcgtggagcggaacctggtgaccccggagggcaaggtcgtggacctgggctgcgggcgcggcgggtggtcctactactgcggcgggctcaagaacgtgaaggaggtcaagggcctgaccaagggcgggcccggccacgaggagcccatccccatgagcacgtacgggtggaacctggtgcggctccagtccggcgtggacgtcttcttcaccccgcccgagaagtgcgacaccctgctgtgcgacatcggggagagctcccccaaccccaccgtggaggccggccgcaccctccgggtgctgaacctggtcgagaactggctcaacaacaacacgcagttctgcatcaaggtgctgaacccgtacatgcccagcgtgatcgagaagatggaggccctgcagcgcaagtacggcggggccctggtccggaaccccctcagccgcaactccacccacgagatgtactgggtgagcaacgcctccggcaacatcgtgagctccgtcaacatgatcagccggatgctgatcaaccgcttcaccatgcggcacaagaaggcgacctacgagccggacgtggacctggggtccggcacgcgcaacatcgggatcgagagcgagacccccaacctcgacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctgaccaagccctgggacgtgatcccgatggtcacccagatggccatgacggacaccacccccttcgggcagcagcgcgtgttcaaggagaaggtcgacacccggacgcaggagcccaaggagggcaccaagaagctcatgaagatcaccgccgagtggctgtggaaggagctgggcaagaagaagacgccccgcatgtgcacgcgggaggagttcacccgcaaggtgcggagcaacgcggccctcggggccatcttcaccgacgagaacaagtggaagtccgcccgcgaggccgtggaggacagcggcttctgggagctggtcgacaaggagcggaacctgcacctcgaggggaagtgcgagacctgcgtgtacaacatgatgggcaagcgcgagaagaagctgggggagttcggcaaggcgaagggctcccgggccatctggtacatgtggctgggggcccgcttcctcgagttcgaggccctgggcttcctgaacgaggaccactggttcagccgggagaactccctcagcggggtggagggcgaggggctgcacaagctgggctacatcctccgcgacgtcagcaagaaggagggcggggcgatgtacgccgacgacacggccggctgggacacccggatcaccctggaggacctgaagaacgaggagatggtgaccaaccacatggagggggagcacaagaagctcgccgaggccatcttcaagctgacgtaccagaacaaggtggtccgcgtgcagcggccgacgccccgcggcaccgtgatggacatcatctcccggcgcgaccagcgggggagcggccaggtcgtgacctacggcctgaacaccttcaccaacatggaggcgcagctcatccgccagatggagggggagggcgtgttcaagtccatccagcagctgaccgtcaaggaggagatcgccgtgaagaactggctgatccgggtggggcgcgagcgcctcagccggatggccatctccggcgacgactgcgtcgtgaagcccctggacgaccgcttcgccagcgccctgaccgcgctcaacgacatgggcaaggtgcggaaggacatccagcagtgggagccctcccgcgggtggaacgactggacgcaggtcccgttctgcagccaccacttccacgagctgatcatgaaggacggccgggtgctggtggtcccctgccgcaaccaggacgagctcatcgggcgggcccgcatctcccagggcgccgggtggagcctgcgggagaccgcctgcctgggcaagtcctacgcccagatgtggagcctcatgtacttccaccgccgggacctgcgcctggcggccaacgccatctgctccgccgtgcccagccactggatccccacctcccggaccacctggagcatccacgccacgcacgagtggatgaccaccgaggacatgctcaccgtgtggaaccgcgtctggatccaggagaacccgtggatggaggacaagacgcccgtggagtcctgggaggagatcccctacctgggcaagcgggaggaccagtggtgcgggagcctgatcggcctcaccagccgcgcgacctgggccaagaacatccagaccgccatcaaccaggtgcggtccctgatcgggaacgaggagtacacggactacatgcccagcatgaagcgcttccggcgcgaggaggaggaggccggcgtcctgtggtga

SEQ ID NO: 9640 - RNA, 9876 nt, synthetic construct
  misc_feature 1..9876: note = derived and/or modified CDS sequence (opt1) from DENV-2__KM279576__SS-prME
  source 1..9876: mol_type = other RNA
accgcgggcatcatcatcatgatgatccccaccgtgatggccttccacctgaccacccgcaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggaccctgcgcccccagccgaccgagctgaagtactcctggaaggcgtggggcaaggccaagatgctcagcacggagctgcacaaccacaccttcctgatcgacggccccgagaccgccgagtgccccaacaccaaccgggcctggaactccctcgaggtggaggactacgggttcggcgtcttcacgaccaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggccgaagtcccacaccctgtggagcaacggcgtgctcgagtccgagatgatcatccccaagaacttcgcgggccccgtgagccagcacaactaccgccccgggtaccacacccagacggccggcccgtggcacctggggcggctggagatggacttcgacttctgcgagggcaccaccgtcgtggtgaccgaggactgcgggaaccgcggcccctccctccggacgaccaccgccagcggcaagctgatcaccgagtggtgctgccgcagctgcacgctgccgcccctccggtaccgcggggaggacggctgctggtacgggatggagatccggccgctgaaggagaaggaggagaacctggtcaactccctcgtgaccgccggccacgggcagatcgacaacttcagcctgggcgtgctgggcatggccctcttcctggaggagatgctgcgcacccgggtcgggaccaagcacgccatcctcctggtggccgtgtccttcgtcacgctgatcaccggcaacatgagcttccgcgacctcgggcgcgtgatggtgatggtcggcgccaccatgaccgacgacatcgggatgggcgtgacgtacctggccctgctcgcggccttcaagatccggcccaccttcgccgccggcctgctgctccgcaagctgacctccaaggagctgatgatgaccacgatcgggatcgtgctcctgagccagtccaccatccccgagagcatcctggagctcaccgacgccctggcgctgggcatgatggtcctcaagatcgtgcggaacatggagaagtaccagctggccgtcaccatcatggccatcctgtgcgtgcccaacgccgtgatcctccagaacgcctggaaggtctcctgcacgaccctggcggtggtgagcgtctccccgctgctcctgaccagctcccagcagaaggccgactggatccccctggccctcaccatcaaggggctgaaccccacggccatcttcctgaccaccctcagccgcacctccaagaagcggagctggcccctgaacgaggcgatcatggccgtgggcatggtgtccatcctggccagctccctcctgaagaacgacatcccgatgacgggccccctggtcgccgggggcctcctgaccgtgtgctacgtgctgaccgggcgcagcgccgacctcgagctggagcgggcggccgacgtccgctgggaggagcaggccgagatcagcggctccagccccatcctgtccatcaccatcagcgaggacgggtccatgagcatcaagaacgaggaggaggagcagacgctcaccatcctgatccggaccggcctgctcgtgatctccggcctgttccccgtgagcatcccgatcaccgccgccgcgtggtacctgtgggaggtcaagaagcagcgcgccggggtgctctgggacgtgcccagcccgccgcccgtcggcaaggccgagctggaggacggggcctaccggatcaagcagaagggcatcctggggtacagccagatcggcgccggcgtgtacaaggaggggaccttccacacgatgtggcacgtgacccgcggcgcggtcctcatgcacaaggggaagcggatcgagccctcctgggccgacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagaccaacacgggcaccatcggggccgtgtccctcgacttcagccccggcacctccggcagccccatcgtcgacaagaaggggaaggtggtgggcctgtacgggaacggcgtcgtgacccggtccggcacgtacgtgagcgcgatcgcccagaccgagaagtccatcgaggacaacccggagatcgaggacgacatcttccgcaagaagcggctgaccatcatggacctgcaccccggggccggcaagaccaagcgctacctccccgccatcgtccgggaggcgatcaagcgcgggctgcggacgctgatcctcgcccccacccgcgtggtggccgccgagatggaggaggccctgcgcggcctgccgatccggtaccagacccccgcgatccgcgccgagcacaccgggcgggagatcgtcgacctcatgtgccacgccacgttcaccatgcgcctgctgagccccatccgggtgcccaactacaacctcatcatcatggacgaggcccacttcaccgacccggccagcatcgcggcccgcggctacatctccacccgggtggagatgggcgaggccgccgggatcttcatgacggccacgccgcccggcagccgcgaccccttcccgcagtccaacgcgcccatcatggacgaggagaaggagatccccgagcggagctggaactccgggcacgagtgggtcaccgacttcaagggcaagaccgtgtggttcgtgcccagcatcaaggccgggaacgacatcgccgcctgcctgcgcaagaacggcaagaaggtcatccagctgtcccggaagacgttcgacagcgagtacatcaagacccgcaccaacgactgggacttcgtggtgaccacggacatctccgagatgggcgcgaacttcaaggccgagcgggtcatcgacccgcgccggtgcatgaagcccgtgatcctcaccgacggggaggagcgcgtgatcctggccggccccatgcccgtcacccacagctccgccgcccagcggcgcgggcgggtgggccgcaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtggacgccatcgacggcgagtaccggctgcgcggggaggcccggaagacgttcgtcgacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggaccaaggagggggagcggaagaagctgaagccccgctggctggacgcccggacctactccgacccgctcgccctgaaggagttcaaggagttcgcggccggccgcaagagcctgaccctcaacctgatcacggagatgggccggctgcccaccttcatgacccagaaggccaagaacgccctcgacaacctggcggtgctgcacaccgccgaggccgggggccgcgcctacaaccacgccctctccgagctgcccgagacgctggagaccctcctgctgctcaccctgctggcgaccgtgaccgggggcatcttcctcttcctgatgagcggcaaggggatcggcaagatgacgctggggatgtgctgcatcatcaccgcctccatcctcctgtggtacgcccagatccagccccactggatcgccgccagcatcatcctggagttcttcctcatcgtcctgctgatcccggagcccgagaagcagcggacgccccaggacaaccagctcacctacgtggtgatcgcgatcctgacggtcgtggccgccaccatggccaacgagatgggcttcctggagaagaccaagaaggacttcgggctcggctccatcaccacgcagcagcccgagagcaacatcctggacatcgacctgcgcccggccagcgcgtggaccctctacgccgtggccaccaccttcatcacgcccatgctgcggcactccatcgagaacagctccgtcaacgtgagcctgaccgccatcgccaaccaggcgaccgtgctcatgggcctggggaagggctggcccctgtccaagatggacatcggggtccccctcctggccatcggctgctacagccaggtgaacccgatcaccctgacggccgccctcctgctgctcgtggcgcactacgccatcatcgggcccggcctgcaggccaaggccacccgcgaggcccagaagcgggcggccgccggcatcatgaagaaccccaccgtcgacgggatgaccgtgatcgacctggaccccatcccgtacgaccccaagttcgagaagcagctcggccaggtgatgctgctggtcctctgcgtgacccaggtgctgatgatgcgcaccacctgggccctgtgcgaggccctcaccctggcgacggggcccatctccaccctgtgggagggcaaccccgggcggttctggaacaccaccatcgccgtcagcatggccaacatcttccgcggctcctacctcgccggcgccgggctgctgttcagcatcatgaagaacacggcgaacacccgccggggcaccgggaacaccggcgagacgctcggcgagaagtggaagaaccgcctgaacgccctggggaagtccgagttccagatctacaagaagtccggcatccaggaggtggaccggaccctcgccaaggaggggatcaagcgcggcgagaccgaccaccacgccgtgagccgggggagcgcgaagctgcgctggttcgtcgagcggaacctggtgaccccggagggcaaggtggtcgacctcggctgcgggcgcggcgggtggtcctactactgcggcgggctgaagaacgtgaaggaggtgaagggcctgacgaagggcgggcccggccacgaggagcccatccccatgagcacctacgggtggaacctcgtccggctgcagtccggcgtggacgtgttcttcaccccgcccgagaagtgcgacaccctgctctgcgacatcggggagagctcccccaaccccaccgtcgaggccggccgcacgctgcgggtgctgaacctcgtggagaactggctgaacaacaacacccagttctgcatcaaggtcctgaacccgtacatgcccagcgtgatcgagaagatggaggccctgcagcgcaagtacggcggggccctcgtgcggaaccccctgagccgcaactccacccacgagatgtactgggtcagcaacgcctccggcaacatcgtgagctccgtgaacatgatcagccggatgctgatcaaccgcttcaccatgcggcacaagaaggcgacgtacgagccggacgtcgacctcgggtccggcacccgcaacatcgggatcgagagcgagacccccaacctggacatcatcggcaagcggatcgagaagatcaagcaggagcacgagacctcctggcactacgaccaggaccacccctacaagacgtgggcctaccacggcagctacgagaccaagcagaccgggtccgccagctccatggtgaacggcgtggtccgcctgctcaccaagccctgggacgtgatcccgatggtgacgcagatggccatgaccgacaccacccccttcgggcagcagcgcgtcttcaaggagaaggtggacacgcggacccaggagcccaaggagggcaccaagaagctgatgaagatcaccgccgagtggctgtggaaggagctcggcaagaagaagacgccccgcatgtgcacccgggaggagttcacccgcaaggtccggagcaacgcggccctgggggccatcttcaccgacgagaacaagtggaagtccgcccgcgaggccgtggaggacagcggcttctgggagctggtggacaaggagcggaacctccacctggaggggaagtgcgagacgtgcgtctacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaactccctgagcggggtggagggcgaggggctgcacaagctcggctacatcctgcgcgacgtgagcaagaaggagggcggggcgatgtacgccgacgacaccgccggctgggacacccggatcaccctggaggacctcaagaacgaggagatggtcacgaaccacatggagggggagcacaagaagctggccgaggccatcttcaagctgacctaccagaacaaggtggtgcgcgtccagcggccgacgccccgcggcaccgtgatggacatcatctcccggcgcgaccagcgggggagcggccaggtggtcacctacggcctcaacaccttcaccaacatggaggcgcagctgatccgccagatggagggggagggcgtgttcaagtccatccagcagctgaccgtgaaggaggagatcgccgtcaagaactggctcatccgggtggggcgcgagcgcctgagccggatggccatctccggcgacgactgcgtggtcaagcccctggacgaccgcttcgccagcgccctcacggcgctgaacgacatgggcaaggtgcggaaggacatccagcagtgggagccctcccgcgggtggaacgactggacccaggtgccgttctgcagccaccacttccacgagctgatcatgaaggacggccgggtcctcgtggtgccctgccgcaaccaggacgagctgatcgggcgggcccgcatctcccagggcgccgggtggagcctgcgggagaccgcctgcctcggcaagtcctacgcccagatgtggagcctgatgtacttccaccgccgggacctgcgcctcgcggccaacgccatctgctccgccgtccccagccactggatccccacctcccggaccacgtggagcatccacgccacccacgagtggatgaccaccgaggacatgctgacggtgtggaaccgcgtgtggatccaggagaacccgtggatggaggacaagacccccgtcgagtcctgggaggagatcccctacctgggcaagcgggaggaccagtggtgcgggagcctcatcggcctgaccagccgcgcgacctgggccaagaacatccagacggccatcaaccaggtgcggtccctgatcgggaacgaggagtacaccgactacatgcccagcatgaagcgcttccggcgcgaggaggaggaggccggcgtgctctggtga

SEQ ID NO: 9641 - RNA, 9876 nt, synthetic construct
  misc_feature 1..9876: note = derived and/or modified CDS sequence (opt1) from DENV-2__KC964095__SS-prME
  source 1..9876: mol_type = other RNA
agcgcgggcatgatcatcatgctgatccccaccgtgatggccttccacctcaccacccgcaacggggagccccacatgatcgtgagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgaccgctggtgcaacagcaccagcacctgggtgacctacgggacctgcaccaccaccggcgagcaccggcgcgagaagcggagcgtcgccctggtgccccacgtgggcatggggctcgagacgcgcaccgagacctggatgagctccgagggcgcctggaagcacgcccagcggatcgagacctggatcctgcgccaccccgggttcacgatcatggccgcgatcctggcctacaccatcggcaccacccacttccagcgggccctcatcttcatcctgctgacggccgtcgcgccgcccatgaccatgcgctgcatcgggatcagcaaccgggacttcgtggagggcgtgtccggcgggagctgggtcgacatcgtgctcgagcacggctcctgcgtgaccaccatggccaagaacaagcccacgctggacttcgagctgatcaagaccgaggccaagcagccggccaccctccgcaagtactgcatcgaggccaagctgaccaacacgaccaccgagagccggtgccccacccagggggagccctccctgaaggaggagcaggacaagcgcttcgtctgcaagcacagcatcgtggaccggggctggggcaacgggtgcggctccttcgggaagggcgggatcgtgacgtgcgcgatgttcacgtgcaagaagaacatggagggcaagatcgtccagcccgagaacctcgagtacaccatcgtggtgaccccgcacagcggcgaggagcacgccatcgggaacgacacgggcaagcacgggaaggagatcaaggtcacgccccagtccagcgtgaccgaggccgagctgaccggctacgggaccgtgacgatcgagtgcagcccccgcaccggcctggacttcaacgagatggtcctcctgcagatgggcaacaaggcctggctggtgcaccggcagtggttcctcgacctgcccctgccgtggctccccggggccgacacccagggcagcaactggatccagaaggagaccctggtgacgttcaagaacccccacgcgaagaagcaggacgtcgtggtcctggggagccaggagggcgccatgcacaccgccctcaccggggccaccgagatccagatgtccagcggcaacctgctgttcacgggccacctcaagtgcgggctgcgcatggacaagctgcagctcaagggcatgtcctacagcatgtgcaccgggaagttcaaggtggtgaaggagatcgccgagacccagcacggcaccatcgtcatccgggtgcagtacgagggcgacgggtccccctgcaagatcccgttcgagatcatggacctggagaagcgctacgtgctgggccggctcatcacggtcaaccccatcgtgaccgagaaggacagccccgtgaacatcgaggcggagcccccgttcggggactcctacatcatcatcggcgtcgagcccgggcagctgaagctgaactggttcaagaagggcagctccatcggccagatgttcgagaccaccatgcgcggggccaagcgcatggccatcctcggcgacacggcctgggacttcgggagcctgggcggggtgttcacctccatcggcaaggccctgcaccaggtgttcggcgcgatctacggggccgccttcagcggcgtctcctggaccatgaagatcctcatcggggtgatcatcacctggatcggcatgaacagccggtccacgagcctgtccgtgagcctggtcctggtggggatcgtgaccctctacctgggcgtcatggtgcaggccgactccggctgcgtggtcagctggaagaacaaggagctgaagtgcgggagcggcatcttcatcaccgacaacgtgcgcacctggacggagcagtacaagttccagcccgagtcccccagcaagctcgcgtccgccatccagaaggcccaggaggaggggatctgcggcatccggagcgtgacccgcctggagaacctgatgtggaagcagatcaccccggagctcaaccacatcctggccgagaacgaggtcaagctgaccatcatgacgggggacatcaagggcaccatgcaggccggcaagcggtccctccgcccccagcccaccgagctgaagtacagctggaagacctgggggaaggcgaagatgctgtccacggagagccacaaccagaccttcctcatcgacggcccggagaccgccgagtgccccaacaccaaccgggcctggaactccctggaggtggaggactacgggttcggcatgttcacgaccaacatctggctgcagctcaaggagaagcaggacgccttctgcgacagcaagctgatgtccgccgcgatcaaggacaaccgcgccgtgcacgccgacatgggctactggatcgagagcgccctgaacgacacctggaagatcgagaaggcctccttcatcgaggtcaagaactgccactggcccaagagccacaccctctggtccaacggggtgctggagagcgagatgatcatccccaagaacctggcgggcccggtgtcccagcacaactaccggcccgggtaccacacccagatcgccggcccctggcaccaggggaagcccgagatggacttcgacttctgcgacggcacgaccgtcgtggtgaccgaggactgcggcaaccgcgggccgagcctccggaccacgaccgccagcggcaagctgatcaccgagtggtgctgccgctcctgcaccctgccgcccctgcggtaccgcggggaggacggctgctggtacgggatggagatccggcccctgaaggagaaggaggagaacctggtcaacagcctcgtgacggccggccacggccagatcgacaacttctccctgggggtgctgggcatggccctcttcctggaggagatgctgcgcacccgggtcgggaccaagcacgccatcctcctggtggccgtgagcttcgtcaccctgatcacgggcaacatgtccttcaaggacctcgggcgcgtggtggtcatggtgggcgccaccatgaccgacgacatcggcatgggggtgacctacctggccctgctcgcggccttcaaggtccggccgacgttcgccgccggcctgctgctccgcaagctgaccagcaaggagctgatgatgaccaccatcgggatcgtgctcctgtcccagagcacgatccccgagaccgtgctggagctcaccgacgccctggcgctgggcatgatggccctcaagatcgtccgcgacatggagaagtaccagctggccgtgaccatcatggccatcctgtgcgtgcccaacgccgtcatcctccagaacgcgtggaaggtgtcctgcacgatcctggccgtcgtgagcgtgagccccctgctcctgaccagctcccagcagaagaccgactggatcccgctggccctcaccatcaagggcctgaaccccacggccatcttcctgaccaccctcagccggaccaacaagaagcgctcctggcccctgaacgaggcgatcatggccgtcgggatggtgagcatcctggcctccagcctcctgaagaacgacatccccatgacgggcccgctggtggccgggggcctcctgaccgtctgctacgtgctgaccgggcggtccgccgacctcgagctggagcgcgcgaccgacgtgaactgggaggaccaggccgagatcagcggcagctcccccatcctgagcatcacgatctccgaggacggcagcatgtccatcaagaacgaggaggaggagcagaccctcaccatcctgatccggaccgggctgctcgtcatcagcggcctgttccccgtgtccatccccatcaccgccgccgcctggtacctgtgggaggtgaagaagcagcgcgcgggggtcctctgggacgtgccgtccccgccgcccatgggcaaggccgagctggaggacggggcctaccggatcaagcagaagggcgtgctgggctactcccagatcggggccggcgtctacaaggaggggacgttccacaccatgtggcacgtgacccgcggcgccgtgctcatgcacaaggggaagcggatcgagcccagctgggcggacgtcaagaaggacctgatctcctacggcggcgggtggaagctgggcggggagtggaaggagggcgaggaggtccaggtgctcgccctggagcccgggaagaacccccgcgccgtccagaccaagcccggcctgttcaagacgaacaccggcaccatcggggccgtgagcctcgacttctcccccggcaccagcgggtcccccatcatcgacaagaagggcaaggtggagggcctgtacgggaacggcgtcgtgacgcggagcgggacctacgtgtccgccatcgcgcagaccgagaagtccatcgaggacaaccccgagatcgaggacgacatcttccgcaagaagcggctgaccatcatggacctccacccgggcgccgggaagacgaagcgctacctgcccgccatcgtccgggaggccatcaagcgcggcctgcggaccctgatcctcgcgcccacccgcgtggtggccgccgagatggaggaggccctgcggggcctgcccatccgctaccagaccccggccatccgggcggagcacacggggcgcgagatcgtcgacctcatgtgccacgccaccttcaccatgcgcctgctgtcccccgtgcgggtgcccaactacaacctcatcatcatggacgaggcccacttcaccgaccccgccagcatcgccgcgcgcggctacatcagcacgcgggtcgagatgggggaggccgccggcatcttcatgaccgccaccccgcccgggtcccgcgaccccttcccccagagcaacgccccgatcatcgacgaggagcgggagatccccgagcgctcctggaacagcggccacgagtgggtgaccgacttcaagggcaagacggtgtggttcgtcccctccatcaaggcggggaacgacatcgccgcctgcctgcggaagaacggcaagaaggtgatccagctgagccgcaagaccttcgactccgagtacgtgaagacccggaccaacgactgggacttcgtcgtgacgaccgacatcagcgagatgggggccaacttcaaggcggagcgcgtgatcgacccccggcgctgcatgaagccggtcatcctcaccgacggcgaggagcgggtgatcctggccgggcccatgcccgtgacccactccagcgccgcccagcgccggggccgcatcggccggaaccccaagaacgagaacgaccagtacatctacatgggggagccgctggagaacgacgaggactgcgcccactggaaggaggcgaagatgctcctggacaacatcaacacgcccgagggcatcatcccctccatgttcgagccggagcgcgagaaggtcgacgccatcgacggggagtaccggctgcgcggcgaggcccgcaagaccttcgtggacctcatgcggcgcggggacctgcccgtgtggctggcctacaaggtcgccgcggagggcatcaactacgccgaccggcgctggtgcttcgacggcatcaagaacaaccagatcctcgaggagaacgtggaggtggagatctggaccaaggagggggagcggaagaagctgaagccccgctggctggacgcccggatctacagcgaccccctcgccctgaaggagttcaaggagttcgccgcgggccgcaagtccctgaccctcaacctgatcacggagatggggcggctgccgaccttcatgacccagaagacccgcgacgccctcgacaacctggccgtcctgcacacggccgaggcgggcggccgggcctacaaccacgccctcagcgagctgcccgagaccctggagaccctcctgctgctcaccctgctggccaccgtgaccggcgggatcttcctcttcctgatgtccgggcgcgggatcgggaagatgaccctgggcatgtgctgcatcatcaccgccagcatcctcctgtggtacgcgcagatccagccccactggatcgccgcctccatcatcctggagttcttcctcatcgtcctgctgatccccgagccggagaagcagcggacgccccaggacaaccagctcacgtacgtggtgatcgccatcctgaccgtcgtggccgcgaccatggccaacgagatgggcttcctggagaagaccaagaaggacctcgggctgggcagcatcacgacccagcagcccgagtccaacatcctggacatcgacctgcccccggccagcgcctggaccctctacgccgtggcgaccacgttcgtcacccccatgctgcgccacagcatcgagaactccagcgtgaacgtgtccctcaccgccatcgccaaccaggccaccgtcctgatggggctgggcaaggggtggcccctcagcaagatggacatcggcgtgcccctgctggccatcggctgctactcccaggtgaacccgatcacgctcaccgcggccctgctgctcctggtcgcccactacgccatcatcgggcccggcctgcaggcgaaggccacccgggaggcccagaagcgcgccgccgcggggatcatgaagaaccccaccgtggacggcatcacggtgatcgacctcgaccccatcccgtacgaccccaagttcgagaagcagctggggcaggtcatgctgctcgtgctgtgcgtgacccaggtcctgatgatgcggaccacctgggccctctgcgaggccctgacgctggccaccggccccatcagcaccctctgggagggcaaccccgggcgcttctggaacaccacgatcgccgtgtccatggcgaacatcttccggggcagctacctggccggggccggcctcctcttctccatcatgaagaacaccaccaacacccgccggggcacggggaacatcggcgagaccctgggggagaagtggaagtcccgcctgaacgccctcggcaagtccgagttccagatctacaagaagtccgggatccaggaggtggaccgcaccctggccaaggagggcatcaagcggggcgagaccgaccaccacgcggtctcccgcgggagcgccaagctgcggtggttcgtggagcgcaacatggtgacgccggagggcaaggtcgtggacctcgggtgcggccgcggcgggtggtcctactactgcggcgggctgaagaacgtgcgcgaggtcaaggggctgaccaagggcggccccgggcacgaggagcccatccccatgagcacctacggctggaacctcgtgcggctgcagtccggcgtggacgtcttcttcatcccgcccgagaagtgcgacaccctgctctgcgacatcggggagtggagccccaacccgaccgtggaggccggccgcacgctgcgggtgctgaacctcgtcgagaactggctgaacaacaacacccagttctgcatcaaggtgctgaacccctacatgccctccgtgatcgagaagatggagaccctccagcgcaagtacgggggcgccctggtccggaaccccctgagccgcaacagcacccacgagatgtactgggtgtccaacgcgagcgggaacatcgtgtccagcgtcaacatgatctcccggatgctgatcaaccgcttcacgatgcggcacaagaaggccacctacgagccggacgtggacctcggcagcggcacccgcaacatcgggatcgagtccgagacccccaacctggacatcatcggcaagcggatcgggaagatcaagcaggagcacgagacgagctggcactacgaccaggaccacccctacaagacctgggcctaccacggctcctacgagaccaagcagaccggcagcgcctccagcatggtggacggggtcgtgcgcctgctcacgaagccctgggacgtgatcccgatggtcacccagatggccatgaccgacaccacgcccttcggccagcagcgggtgttcaaggagaaggtggacacccgcacccaggagcccaaggaggggaccaagaagctgatgaagatcacggcggagtggctgtggaaggagctcggcaagaaggagacgccccggatgtgcacccgggaggagttcacccgcaaggtccggtccaacgccgccctgggggccatcttcacggacgagaacaagtggaagtccgcccgcgaggcggtggaggactccggcttctgggagctggtggacaaggagcggaacctccacctggagggcaagtgcgagacctgcgtctacaacatgatggggaagcgcgagaagaagctgggcgagttcgggaaggccaagggcagccgggccatctggtacatgtggctcggggcccgcttcctggagttcgaggccctgggcttcctcaacgaggaccactggttctcccgggagaacagcctgtccggcgtggagggggagggcctgcacaagctcgggtacatcctgcgcgacgtcagcaagaaggagggcggggcgatgtacgccgacgacaccgccggctgggacacccggatcacgctggaggacctcaagaacgaggagatggtgaccaaccacatggagggcgagcacaagaagctggccgaggcgatcttcaagctgacctaccagaacaaggtggtccgcgtgcagcggccgccgccccgcgggaccgtgatggacatcatcagccggcgcgaccagcggggctccgggcaggtcgtgacgtacggcctcaacaccttcaccaacatggaggcccagctgatccgccagatggagggcgagggggtgttcaagaacatccagcacctgaccgtcacggaggagatcgccgtgcagaactggctcgcccgggtgggccgcgagcggctgagccgcatggccatctccggggacgactgcgtcgtgaagcccctggacgaccgcttcgcgagcgccctcaccgccctgaacgacgtgggcaagatccggaaggacatccagcagtgggagccctcccgcgggtgggacgactggacccaggtccccttctgcagccaccactcccacgagctgatcatgaaggacggccgggtgctcgtggtcccctgccgcaaccaggacgagctgatcggccgggcccgcatcagccagggggccggctggtccctgcgggagaccgcgtgcctcggcaagagctacgcccagatgtggtccctgatgtacttccaccgccgggacctgcgcctcgccgccaacgccatctgcagcgcggtgccctcccactgggtgccgaccagccggacgacctggtccatccacgccaagcacgagtggatgaccaccgaggacatgctgacggtctggaaccgcgtgtggatccaggagaacccctggatggaggacaagacccccgtggagagctgggaggagatcccctacctgggcaagcgggaggggcagtggtgcggctccctcatcggcctgaccagccgcgccacctgggccaagaacatccagacggccatcaaccaggtccggagcctgatcgggaacgaggagtacaccgactacatgccgtccatgaagcgcttccggcgcgaggaggaggaggcgggcgtgctctggtga

SEQ ID NO: 9642 - RNA, 9876 nt, synthetic construct
  misc_feature 1..9876: note = derived and/or modified CDS sequence (opt1) from DENV-2__KC964094__SS-prME
  source 1..9876: mol_type = other RNA
agcgccggcatgatcatcatgctgatccccaccgtgatggccttccacctcaccacccgcaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaactccaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctgggtcctgcggcaccccgggttcaccatcatggccgcgatcctggcctacaccatcggcaccacctacttccagcgcgtgctcatcttcatcctgctgacggccgtggcccccagcatgaccatgcggtccatcgggatcagcaaccgcgacttcgtcgagggcgtgtccggcgggagctgggtggacgtcgtgctcgagcacggctcctgcgtgaccaccatggcgaagaacaagcccacgctggacttcgagctgaccaagaccgaggccaagcaccccgccaccctccggaagtactgcatcgaggccaagctgacgaacaccaccaccgccagccgctgcccgacgcagggggagccctccctgaacgaggagcaggacaagcggttcgtctgcaagcacagcatggtggaccgcggctggggcaacgggtgcggcctcttcgggaagggcgggatcgtgacctgcgcgatgttcacgtgcaagaagaacatggagggcaaggtcgtgcagcccgagaacctggagtacaccatcgtgatcacgccccactccggcgaggagaacgccgtcgggaacgacaccggcaagcacgggaaggagatcaaggtgaccccgcagagctccgtgaccgaggccgagctgaccggctacgggacggtcaccatggagtgcagcccccggaccggcctcgacttcaacgagatggtgctgctgcagatgaagaacaaggcctggctcgtccaccgccagtggttcctggacctgcccctcccctggctgccgggcgccgacacccaggggagcaactggatccagaaggagacgctggtgaccttcaagaacccccacgcgaagaagcaggacgtggtcgtgctcggctcccaggagggggccatgcacaccgccctgaccggcgccacggagatccagatgagctccgggaacctgctgttcaccggccacctgaagtgccggctgcgcaccgacaagctccagctgaagggcatgagctactccatgtgcaccgggaagttcaaggtggtcaaggagatcgccgagacgcagcacggcaccatcgtgatccgggtgcagtacgagggggacggcagcccctgcaagatccccttcgagatcatggacctggagaagcgccacgtcctcggccggctgatcaccgtgaacccgatcgtgaccgagaaggactcccccgtcaacatcgaggcggagccgcccttcggggacagctacatcatcatcggcgtggagccggggcagctgaagctctcctggttcaagaaggagagctccatcggccagatgttcgagacgaccatgcgcggggccaagcgcatggccatcctgggcgacaccgcctgggacttcggcagcctcggcggggtgttcacctccatcgggaaggccctccaccaggtcttcggggcgatctacggggccgccttcagcggcgtgtcctggacgatgaagatcctgatcggcgtggtcatcacctggatcgggatgaacagccggtccaccagcctgtccgtgagcctggtgctcgtcggcgtggtgaccctgtacctgggggtcatggtgcaggccgacagcggctgcgtggtctcctggaagaacaaggagctcaagtgcgggagcggcatcttcgtgacggacaacgtgcacacctggaccgagcagtacaagttccagcccgagtcccccagcaagctggcgtccgccatccagaaggcccacgaggagggcatctgcgggatccgcagcgtcacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaaggcctgggggaaggcgaagatgctcagcacggagctgcacaaccacaccttcctgatcgacggccccgagaccgccgagcgcccgaacaccaaccgggcctggaactccctcgaggtggaggactacggcttcggggtcttcacgaccaacatctggctgaagctgaaggagcgccaggacgtgttctgcgacagcaagctcatgtccgccgccatcaaggacaaccgggcggtgcacgccgacatgggctactggatcgagagcgccctgaacgacacctggaagatcgagaaggcctccttcatcgaggtcaagagctgccactggcccaagtcccacaccctgtggagcaacggggtgctcgagagcgagatgatcatccccaagaacttcgccggccccgtgtcccagcacaactaccgcccgggctaccacacccagacggcggggccctggcacctgggccggctggagatggacttcgacttctgcgaggggaccaccgtcgtggtgaccgaggactgcggcaaccgcgggcccagcctccggacgaccaccgcctccggcaagctgatcaccgagtggtgctgccgcagctgcacgctgcccccgctccggtaccgcggcgaggacgggtgctggtacggcatggagatccggcccctgaaggagaaggaggagaacctggtcaactccctcgtgaccgccgggcacggccagatcgacaacttcagcctgggggtgctgggcatggccctcttcctggaggagatgctgcgcacccgggtcggcaccaagcacgcgatcctcctggtggccgtgtccttcgtcacgctgatcaccgggaacatgagcttccgcgacctcggccgcgtgatggtgatggtcggggccaccatgaccgacgacatcggcatgggggtgacgtacctggccctgctcgccgcgttcaaggtccggcccaccttcgccgccggcctgctgctccgcaagctgacctccaaggagctgatgatgaccacgatcggcatcgtgctcctgagccagtccaccatccccgagaccatcctggagctcaccgacgccctggccctggggatgatggtgctcaagatcgtccggaacatggagaagtaccagctggcggtgacgatcatggccatcctgtgcgtgccgaacgccgtcatcctccagaacgcctggaaggtgagctgcaccaccctggccgtggtctccgtgagccccctgctcctgacctccagccagcagaaggcggactggatccccctggccctcacgatcaagggcctgaaccccaccgccatcttcctgaccaccctctcccgcacgagcaagaagcggtcctggccgctgaacgaggccatcatggcggtggggatggtcagcatcctggccagctccctcctgaagaacgacatccccatgaccggccccctggtggccggcgggctcctgaccgtgtgctacgtcctggccggccgcagcgccgacctcgagctggagcgggcggccgacgtgcgctgggaggagcaggccgagatctccgggagctcccccatcctgagcatcaccatctccgaggacggcgggatgagcatcaagaacgaggaggaggagcagacgctcaccatcctgatccggaccggcctgctcgtgatctccggcctgttcccggtcagcatccccatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacacgatgtggcacgtcacccgcggcgcggtgctcatgcacaaggggaagcggatcgagccctcctgggccgacgtgaagaaggacctgatcagctacggcgggggctggaagctggagggcgagtggaaggagggggaggagatccaggtcctcgccctggagcccggcaagaacccccgcgccgtgcagaccaagcccgggctgttcaagaccaacacgggcaccatcggggccgtgtccctcgacttcagccccggcacctccggcagccccatcgtcgacaagaaggggaaggtggtgggcctgtacgggaacggcgtcgtgacccggtccggcacgtacgtgagcgcgatcgcccagaccgagaagtccatcgaggacaaccccgagatcgaggacgacaccttccgcaagaagcggctgaccatcatggacctgcaccccggggccggcaagacgaagcgctacctccccgccatcgtccgggaggcgatcaagcgcgggctgcggaccctgatcctcgccccgacccgcgtggtggccgccgagatggaggaggccctgcgcggcctgcccatccggtaccagacccccgcgatccgcgccgagcacacggggcgggagatcgtcgacctcatgtgccacgccaccttcaccatgcgcctgctgtcccccatccgggtgccgaactacaacctcatcatcatggacgaggcccacttcaccgaccccgccagcatcgcggcccgcggctacatctccacgcgggtggagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtcaccgacttcaagggcaagacggtgtggttcgtgccgagcatcaaggccgggaacgacatcgccgcctgcctgcggaagaacggccgcaaggtcatccagctgtcccggaagaccagcgactccgagtacatcaagacccgcaccaacgactgggacttcgtggtgacgaccgacatcagcgagatgggcgcgaacttcaaggccgagcgggtcatcgacccccgccggtgcatgaagcccgtgatcctcaccgacggggaggagcgcgtgatcctggccggccccatgccggtcacccactccagcgccgcccagcggcgcgggcgcgtgggccggaaccccaagaacgagaacgaccagtacatctacatgggggagcccctggagaacgacgaggactgcgcgcactggaaggaggccaagatgctcctggacaacatcaacacgcccgagggcatcatcccgtccatgttcgagcccgagcgcgagaaggtcgacgccatcgacggcgagtaccggctgcgcggggaggcccggaagaccttcgtggacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgcggccggccgcaagtccctgaccctcaacctgatcacggagatgggccggctgcccaccttcatgacccagaaggcccgcaacgccctcgacaacctggcggtgctgcacaccgccgaggccgggggccgggcctacaaccacgccctcagcgagctgcccgagacgctggagaccctcctgctgctcaccctgctggcgaccgtgaccgggggcatcttcctcttcctgatgtccggcaaggggatcggcaagatgacgctggggatgtgctgcatcatcaccgccagcatcctcctgtggtacgcccagatccagccgcactggatcgccgccagcatcatcctggagttcttcctcatcgtcctgctgatccccgagcccgagaagcagcgcacgccccaggacaaccagctcacctacgtggtgatcgcgatcctgacggtcgtggccgccaccatggccaacgagatgggcttcctggagaagaccaagaaggacttcgggctcggctccatcgccacccagcagccggagagcaacatcctggacatcgacctgcggcccgcgtccgcctggacgctctacgccgtggccaccaccttcatcacccccatgctgcgccacagcatcgagaactccagcgtcaacgtgtccctgacggccatcgcgaaccaggccaccgtgctcatgggcctggggaagggctggcccctgagcaagatggacatcggggtcccgctcctggccatcggctgctactcccaggtgaaccccatcaccctgaccgccgcgctcctgctgctcgtggcccactacgccatcatcgggcccggcctgcaggccaaggccacgcgggaggcgcagaagcgcgccgccgccggcatcatgaagaaccccaccgtcgacgggatcaccgtgatcgacctggacccgatcccctacgaccccaagttcgagaagcagctcggccaggtgatgctgctggtcctctgcgtgacccaggtgctgatgatgcgcacgacctgggccctgtgcgaggcgctcaccctggccaccgggcccatcagcacgctgtgggagggcaacccggggcggttctggaacaccaccatcgccgtctccatggccaacatcttccgcggcagctacctcgccggcgcggggctgctgttctccatcatgaagaacaccgccaacacgcggcgcggcaccgggaacaccggcgagaccctcggcgagaagtggaagaaccggctgaacgccctgggcaagagcgagttccagatctacaagaagtccggcatccaggaggtggaccgcacgctcgccaaggaggggatcaagcggggcgagaccgaccaccacgcggtgagccgcgggtccgccaagctgcggtggttcgtcgagcgcaacctggtgacccccgagggcaaggtggtcgacctcggctgcgggcggggcgggtggagctactactgcggcgggctgaagaacgtgaaggaggtgaagggcctgaccaagggcgggcccggccacgaggagcccatcccgatgtccacgtacgggtggaacctcgtccgcctgcagagcggcgtggacgtgttcttcacgccgcccgagaagtgcgacaccctgctctgcgacatcggggagagctcccccaacccgaccgtcgaggccggccggaccctgcgcgtgctgaacctcgtggagaactggctgaacaacaacacgcagttctgcatcaaggtcctgaacccctacatgcccagcgtgatcgagaagatggaggccctgcagcggaagtacggcggggccctcgtgggcaacccgctgtcccgcaacagcacccacgagatgtactgggcgtccaacgccagcgggaacatcgtctccagcgtgaacatgatctcccggatgctgatcaaccgcttcaccatgcggcacaagaaggccacctacgagcccgacgtggacctcggcagcgggacgcgccacatcggcatcgagtccgagacccccaacctggacatcatcggcaagcgcatcgagaagatcaagcaggagcacgagaccagctggcactgcgaccaggaccacccctacaagacctgggcctaccacgggtcctacgaggccaagcagacgggcagcgcgtccagcatggtcaacggggtggtgcggctgctcaccaagccgtgggacgtcatccccatggtgacccagatggccatgaccgacacgacccccttcggccagcagcgcgtcttcaaggagaaggtggacacccggacccaggagcccaaggagggcacgaagaagctgatgaagatcaccgccgagtggctgtggaaggagctcgggaagaagaaggccccgcgcatgtgcacccgggaggagttcacccgcaaggtgcggtccaacgccgcgctgggcgccatgttcacggacgagaacaagtggaagtccgcccgcgaggccgtcgaggactccgggttctgggagctggtggacaaggagcggaacctccacctggagggcaagtgcgagacctgcgtgtacaacatgatggggaagcgcgagaagaagctgggcgagttcggcaaggcgaaggggagccgggccatctggtacatgtggctcggcgcccgcttcctggagttcgaggccctggggttcctcaacgaggaccactggttcagccgggagaactccctgagcggcgtcgagggggagggcctgcacaagctcggctacatcctgcgcgacgtgtccaagaaggagggcggggccatgtacgcggacgacaccgccgggtgggacacccggatcacgctggaggacctcaagaacgaggagatggtgaccaaccacatggagggcgagcacaagaagctggccgaggccatcttcaagctgacctaccagaacaaggtcgtgcgcgtgcagcggcccacgccccgcgggacggtcatggacatcatcagccggcgcgaccagcggggctccggccaggtggtgacctacgggctcaacaccttcaccaacatggaggcccagctgatccgccagatggagggcgagggggtcttcaagagcatccagcacctgacggtgaccgaggagatcgcggtgaagaactggctcgtccgcgtgggccgggagcgcctgtcccggatggccatcagcggcgacgactgcgtggtcaagcccctggacgaccgcttcgcctccgccctcaccgccctgaacgacatggggaaggtgcggaaggacatccagcagtgggagccgagccgcggctggaacgactggacccaggtgcccttctgctcccaccacttccacgagctgatcatgaaggacgggcgggtcctcgtggtgccctgccgcaaccaggacgagctgatcggccgggcgcgcatcagccagggggccggctggtccctgcgggagacggcctgcctcggcaagagctacgcccagatgtggtccctgatgtacttccaccgccgggacctgcgcctcgccgcgaacgccatctgcagcgccgtcccctcccactgggtgccgaccagccggaccacctggagcatccacgccacccacgagtggatgacgaccgaggacatgctgaccgtgtggaaccgcgtctggatccaggagaacccctggatggaggacaagacccccgtggagtcctgggaggagatcccctacctggggaagcgggaggaccagtggtgcggcagcctcatcgggctgacgtcccgcgcgacctgggccaagaacatccagaccgccatcaaccaggtgcggagcctgatcggcaacgaggagtacaccgactacatgccgtccatgaagcgcttccgccgggaggaggaggaggccggggtcctctggtga

SEQ ID NO: 9643 - RNA, 9876 nt, synthetic construct
  misc_feature 1..9876: note = derived and/or modified CDS sequence (opt1) from DENV-2__KC964093__SS-prME
  source 1..9876: mol_type = other RNA
accgccggggtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcacctccacctgggtgacgtacgggacctgcaccgccaccggcgagcaccggcgggagaagcggagcgtggccctggtcccccacgtgggcatggggctggagacgcgcaccgagacctggatgtccagcgagggcgcctggaagcacgcccagcggatcgagacctgggtgctccgccaccccgggttcacgatcatggccgccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgaccaagaccgaggccaagcaccccgccaccctgcgcaagtactgcatcgaggccaagctcacgaacaccaccaccgcgagccggtgcccgacgcagggggagccctccctgaacgaggagcaggacaagcgcttcgtgtgcaagcacagcatggtggaccggggctggggcaacgggtgcggcctgttcgggaagggcgggatcgtgacctgcgccatgttcacgtgcaagaagaacatggagggcaaggtggtgcagcccgagaacctcgagtacaccatcgtcatcacgccccactccggcgaggagaacgtggtggggaacgacaccggcaagcacgggaaggagatcaaggtcaccccgcagagctccatcaccgaggccgagctgaccggctacgggacggtgaccatggagtgcagcccccgcaccggcctggacttcaacgagatggtcctcctgcagatggaggacaaggcctggctggtgcaccggcagtggttcctcgacctgcccctgccctggctcccgggcgccgacacccaggggtccaactggatccagaaggagacgctggtgaccttcaagaacccccacgcgaagaagcaggacgtcgtggtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggccgtcaaggagatcgcggagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacgtggaccgagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaaggcgtggggcaaggccaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcacgaccgtggtcgtgaccgaggactgcgggaaccggggccccagcctgcgcaccacgaccgcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcacggccggccacgggcagatcgacaacttcagcctcggcgtgctgggcatggcgctgttcctcgaggagatgctgcggacccgcgtggggaccaagcacgccatcctgctcgtcgccgtgtccttcgtgaccctgatcacgggcaacatgagctcccgggacctggggcgcgtcatggtgatggtgggcgccaccatgaccgacgacatcgggatgggcgtcacctacctcgccctgctggcggccttcaaggtgcgccccacgttcgccgccggcctcctgctgcggaagctcaccagcaaggagctgatgatgaccaccatcgggatcgtcctgctctcccagagctccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccacgctcgcggtggtgtccgtcagccccctgctgctcacctccagccagcagaaggccgactggatccccctggccctgaccatcaaggggctcaaccccaccgccatcttcctgacgaccctgtcccggaccagcaagaagcgctcctggccgctcaacgaggcgatcatggccgtgggcatggtgagcatcctggccagctccctgctcaagaacgacatccccatgaccggccccctggtcgccgggggcctgctcacggtgtgctacgtgctggccgggcggagcgcggacctggagctcgagcgcgccgccgacgtccggtgggaggagcaggccgagatctccggcagctcccccatcctgagcatcaccatctccgaggacgggggcatgagcatcaagaacgaggaggaggagcagaccctgaccatcctcatccgcacgggcctgctggtgatctccggcctcttcccggtgagcatccccatcaccgccgcggcctggtacctgtgggaggtcaagaagcagcgggccggcgtgctgtgggacgtgcccagcccgccgcccgtcgggaaggccgagctcgaggacggcgcctaccgcatcaagcagaaggggatcctgggctacagccagatcggcgcgggggtgtacaaggagggcaccttccacaccatgtggcacgtgacccgcggggccgtcctgatgcacaagggcaagcgcatcgagccctcctgggccgacgtgaagaaggacctcatcagctacgggggcggctggaagctggagggggagtggaaggagggcgaggagatccaggtgctggccctcgagcccgggaagaacccccgggccgtccagacgaagcccggcctgttcaagaccaacaccgggaccatcggcgcggtgtccctggacttcagccccggcacgtccgggagccccatcgtggacaagaagggcaaggtcgtggggctctacggcaacggcgtggtcacccgctccgggacctacgtgagcgccatcgcccagaccgagaagtccatcgaggacaaccccgagatcgaggacgacatcttccggaagaagcgcctgacgatcatggacctgcaccccggcgccgggaagaccaagcggtacctgcccgcgatcgtgcgcgaggccatcaagcggggcctccgcaccctgatcctggccccgacccgggtcgtggccgccgagatggaggaggcgctccgcgggctgcccatccgctaccagacgcccgccatccgggccgagcacaccggccgcgagatcgtggacctgatgtgccacgccaccttcaccatgcggctcctgtcccccatccgcgtcccgaactacaacctgatcatcatggacgaggcccacttcacggaccccgcgagcatcgccgcccggggctacatctccacccgcgtggagatgggggaggccgccggcatcttcatgaccgcgacgccgcccgggagccgggacccgttcccccagtccaacgcccccatcatggacgaggagcgcgagatccccgagcggagctggaactccggccacgagtgggtgacggacttcaaggggaagaccgtctggttcgtgccgagcatcaaggccggcaacgacatcgccgcgtgcctccgcaagaacggcaagaaggtgatccagctgtcccggaagaccttcgacagcgagtacgtcaagacccgcacgaacgactgggacttcgtggtgaccaccgacatctccgagatgggggccaacttcaaggccgagcgggtcatcgacccccgccggtgcatgaagcccgtgatcctgaccgacggcgaggagcgcgtgatcctcgccgggcccatgccggtcacgcacagctccgccgcgcagcggcgcggccgggtggggcgcaaccccaagaacgagaacgaccagtacatctacatgggcgagcccctggagaacgacgaggactgcgcccactggaaggaggccaagatgctgctcgacaacatcaacacccccgagggcatcatcccgagcatgttcgagcccgagcgcgagcgggtcgacgccatcgacggggagtaccgcctgcggggcgaggcccgcaagaccttcgtggacctgatgcggcgcggggacctccccgtgtggctggcgtaccgggtcgccgccgagggcatcaactacgccgaccgccggtggtgcttcgacggggtgaagaacaaccagatcctggaggagaacgtggaggtcgagatctggaccaaggagggcgagcgcaagaagctcaagccgcggtggctggacgcccgcatctactccgaccccctggcgctcaaggagttcaaggagttcgccgccggccgcaagagcctgacgctgaacctcatcaccgagatggggcgcctgcccaccttcatgacccagaaggcccggaacgcgctggacgacctcgccgtgctgcacacggccgaggccggcgggcgcgcctacaaccacgcgctgtccgagctccccgagaccctggagaccctgctcctgctgaccctcctggccacggtgaccggcggcatcttcctgttcctcatgagcgggaagggcatcgggaagatgaccctgggcatgtgctgcatcatcaccgcctccgtcctgctctggtacgcccagatccagccgcactggatcgccgcgagcatcatcctggagttcttcctgatcgtgctcctgatccccgagcccgagaagcagcggacgccccaggacaaccagctgacgtacgtggccatcgccatcctcaccgtcgtggccgccaccatggcgaacgagatggggttcctggagaagaccaagaaggacttcggcctgggcagcatcgccacgcagcagccggagtccaacatcctcgacctggacctgcgccccgccagcgcctggaccctctacgccgtggcgaccaccttcatcacgcccatgctgcggcactccatcgagaacagctccgtcaacgtgagcctgaccgccatcgccaaccaggccaccgtgctcatggggctgggcaaggggtggcccctgtccaagatggacatcggcgtcccgctcctggcgatcgggtgctacagccaggtgaaccccatcaccctgacggccgccctcctgctgctcgtggcccactacgccatcatcggccccggcctgcaggcgaaggccacccgcgaggcccagaagcgggccgccgcggggatcatgaagaaccccaccgtcgacggcatcaccgtgatcgacctggacccgatcccctacgaccccaagttcgagaagcagctcgggcaggtcatgctgctggtcctctgcgtgacccaggtgctgatgatgcgcaccacctgggccctgtgcgaggccctcaccctggccacgggccccatctccaccctgtgggaggggaacccgggccgcttctggaacaccaccatcgccgtcagcatggcgaacatcttccggggctcctacctcgccggggtgggcctgctgttcagcatcatgaagaacacggccaacacccgccgggggaccggcaacaccggcgagacgctcggggagaagtggaagaaccgcctgaacgccctgggcaagtccgagttccagatctacaagaagtccgggatccaggaggtggaccggaccctcgcgaaggagggcatcaagcgcggggagaccgaccaccacgccgtctcccggggcagcgccaagctgcgctggttcgtggagcggaacctggtgacccccgagggcaaggtcatggacctcgggtgcggccgcgggggctggtcctactactgcgggggcctgaagaacgtgaaggaggtgaagggcctgacgaagggcgggcccgggcacgaggagcccatcccgatgagcacctacggctggaacctcgtccggctgcagtccggggtggacgtgttcttcgcgccgcccgagaagtgcgacaccctgctctgcgacatcggcgagagcagccccaacccgaccgtcgaggccggccgcacgctgcgggtgctgaacctcgtggagaactggctgaacaacaacacccagttctgcatcaaggtcctgaacccctacatgccctccgtgatcgagaagatggaggcgctgcagcgcaagtacgggggcgccctcgtgcggaacccgctgagccgcaactccacccacgagatgtactgggtcagcaacgcctccgggaacatcgtgagctccgtgaacatgatcagccggatgctgatcaaccgcttcaccatgcggcacaagaaggccacctacgagcccgacgtcgacctcggctccgggacgcgcaacatcggcatcgagagcgagatccccaacctggacatcatcggcaagcgcatcgagaagatcaagcaggagcacgagacctcctggcactacgaccaggaccacccctacaagacctgggcctaccacgggagctacgagaccaagcagacgggctccgcgagctccatggtgaacggggtggtccggctgctcaccaagccgtgggacgtgatccccatggtcacccagatggccatgaccgacacgacccccttcggccagcagcgcgtgttcaaggagaaggtggacacccggacccaggagcccaaggagggcacgaagaagctgatgaagatcaccgccgagtggctgtggaaggagctcgggaagaagaagaccccgcgcatgtgcacccgggaggagttcacgcgcaaggtccggagcaacgccgccctgggcgcgatcttcaccgacgagaacaagtggaagtccgcccgcgaggccgtggaggacagcgggttctgggagctggtggacaaggagcggaacctccacctggagggcaagtgcgagacctgcgtctacaacatgatggggaagcgcgagaagaagctgggcgagttcggcaaggccaaggggtcccgggcgatctggtacatgtggctcggcgcccgcttcctggagttcgaggccctggggttcctcaacgaggaccactggttcagccgggagaacagcctgtccggcgtggagggggagggcctgcacaagctcggctacatcctgcgcgaggtgagcaagaaggagggcggggccatgtacgccgacgacaccgcggggtgggacacgcggatcaccctggaggacctcaagaacgaggagatggtcaccaaccacatggagggcgagcacaagaagctggccgaggccatcttcaagctgacctaccagaacaaggtggtgcgcgtccagcggcccacgccccgcgggaccgtgatggacatcatctcccggcgcgaccagcggggcagcggccaggtggtcacctacgggctcaacaccttcacgaacatggaggcccagctgatccgccagatggagggcgagggggtgttcaagtccatccagcacctgaccgtgaccgaggagatcgccgtcaagaactggctcacccgcgtgggccgggagcgcctgagccggatggcgatctccggcgacgactgcgtggtcaagcccctggacgaccgcttcgccagcgccctcacggccctgaacgacatggggaaggtgcggaaggacatccagcagtgggagccgtcccgcggctggaacgactggacccaggtgcccttctgcagccaccacttccacgagctgatcatgaaggacgggcgggtcctcgtggtgccctgccgcaaccaggacgagctgatcggccgggcccgcatctcccagggggcgggctggagcctgcgggagaccgcctgcctcggcaagtcctacgcccagatgtggagcctgatgtacttccaccgccgggacctgcgcctcgccgccaacgcgatctgctccgccgtccccagccactgggtgccgacctcccggacgacctggagcatccacgccacccacgagtggatgaccaccgaggacatgctgacggtgtggaaccgcgtctggatccaggagaacccctggatggaggacaagacccccgtggagagctgggaggagatcccctacctggggaagcgggaggaccagtggtgcggctccctcatcgggctgaccagccgcgccacctgggcgaagaacatccagacggccatcaaccaggtgcggtccctgatcggcaacgaggagtacaccgactacatgccgagcatgaagcgcttccgccgggaggagggggaggccggcgtcctctggtga

SEQ ID NO: 9644 - RNA, 9876 nt, synthetic construct
  misc_feature 1..9876: note = derived and/or modified CDS sequence (opt1) from DENV-2__DQ448231__SS-prME
  source 1..9876: mol_type = other RNA
accgccggggtgatcatcatgctgatccccaccgccatggcgttccacctcaccacccggaacggggagccccacatgatcgtcagccggcaggagaagggcaagagcctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcgcagcggatcgagacctggatcctgcgccaccccgggttcacgatcatggccgccatcctggcctacaccatcggcaccacctacttccagcgggtcctcatcttcatcctgctgacggcggtggccccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggcgaagctgaccaacacgaccaccgccagccggtgccccacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacacggtggggaacgacaccggcaagcacgggaaggagatcaaggtgaccccgcagagctccatcaccgaggccgagctgaccggctacgggacggtcaccatggagtgcagcccccgcaccggcctcgacttcaacgagatggtgctgctgcagatggagaacaaggcctggctcgtgcaccggcagtggttcctggacctgcccctcccctggctgccgggcgcggacacccaggggtccaactggatccagaaggagacgctggtcaccttcaagaacccccacgccaagaagcaggacgtggtcgtgctcggcagccaggagggggccatgcacaccgccctgaccggcgccacggagatccagatgagctccgggaacctcctgttcaccggccacctgaagtgccgcctgcggatggacaagctccagctgaagggcatgagctactccatgtgcaccgggaagttcaaggtggtcaaggagatcgcggagacccagcacggcacgatcgtggtgcgcgtccagtacgagggggacggcagcccctgcaagatccccttcgagatcatggacctggagaagcggcacgtgctcggccgcctgatcaccgtgaacccgatcgtcaccgagaaggactcccccgtgaacatcgaggccgagccgcccttcggggacagctacatcatcatcggcgtggagccggggcagctgaagctctcctggttcaagaagggcagctccatcgggcagatgttcgagaccacgatgcgcggcgccaagcggatggccatcctgggcgacaccgcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacgtggatcggcatgaacagccgctccaccagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacgtggaccgagcagtacaagttccagcccgagtcccccagcaagctggcctccgccatccagaaggcccacgaggaggggatctgcggcatccggagcgtcacccgcctggagaacctcatgtggaagcagatcacccccgagctgaaccacatcctgtccgagaacgaggtgaagctcacgatcatgaccggggacatcaagggcatcatgcaggccgggaagcggagcctgcgcccgcagcccaccgagctgaagtactcctggaagacctggggcaaggcgaagatcctcagcacggagccccacaaccagaccttcctgatcgacggcccggagaccgccgagtgccccaacaccaaccgggcctggaactccctggaggtggaggactacgggttcggcgtcttcacgaccaacatctggctcaagctgaaggagcgccaggacgtgttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggcccggtgagccagcacaactaccgccccgggtaccacacccagacggcgggcccctggcacctcgggaagctggagatggacttcgacttctgcgagggcaccaccgtcgtggtgaccgaggactgcgggaaccggggccccagcctgcgcacgaccaccgcctccggcaagctcatcaccgagtggtgctgccggagctgcacgctgccgcccctgcgctaccgcggggaggacggctgctggtacgggatggagatccgccccctcaaggagaaggaggagaacctggtcaactccctggtgaccgccggccacgggcagatcgacaacttcagcctcggcgtgctgggcatggccctgttcctcgaggagatgctgcggacccgcgtcgggaccaagcacgcggtgctgctcgtggccgtctccttcatgacgctgatcaccggcaacatgagcttccgggacctggggcgcgtgatggtgatggtcggcgccgccatgaccgacgacatcgggatgggcgtgacctacctcgccctgctggcggccttcaaggtgcgccccacgttcgccgccggcctcctgctgcggaagctcacctccaaggagctgatgatgaccaccatcgggatcgtcctgctcagccagtccacgatcccggagaccatcctggagctgaccgacgccctcgcgctgggcatgatgatcctgaagatcgtgcgcaacatggagaagtaccagctcgccgtcaccatcatggccatcctgtgcgtgcccaacgccgtgatcctgcagaacgcctggaaggtcagctgcacgatcctcgcggtggtgtccgtcagccccctgctgctcacctccagccagcagaaggccgactggatccccctggccctgaccatcaaggggctcaacccgaccgccatcttcctgacgaccctgtcccggaccaacaagaagcgcagctggcccctcaacgaggcgatcatggccgtgggcatggtgtccatcctggccagctccctgctcaagaacgacatccccatgaccggccccctggtcgccgggggcctgctcacggtgtgctacgtgctgaccgggcggagcgccgacctggagctcgagcgcgcggccgacgtccggtgggaggaccaggccgagatcagcggctccagcccgatcctgtccatcaccatcagcgaggacgggtccatgagcatcaagaacgaggaggaggagcagaccctgacgatcctcatccgcaccggcctgctggtgatctccggcctcttccccgtgagcatccccatcaccgccgccgcgtggtacctgtgggaggtcaagaagcagcgggccggggtgctgtgggacgtgccctccccgccgcccgtcggcaaggccgagctcgaggacggggcctaccgcatcaagcagaagggcatcctggggtacagccagatcggcgccggcgtgtacaaggaggggaccttccacaccatgtggcacgtgacgcggggcgcggtcctgatgcacaaggggaagcgcatcgagccgtcctgggccgacgtgcggaaggacctcatcagctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggccgtgtccctggacttcagcccgggcacctccggcagccccatcgtcgacaagaaggggaaggtggtgggcctctacgggaacggcgtcgtgacccggtccggcacctacgtgagcgcgatcgcccagacggagaagtccatcgaggacaaccccgagatcgaggacgacatcttccgcaagaagcggctgaccatcatggacctgcaccccggggccggcaagaccaagcgctacctgccggccatcgtccgggaggcgatcaagcgcgggctccggaccctgatcctggcccccacgcgcgtggtggccgccgagatggaggaggccctccgcggcctgcccatccggtaccagacccccgcgatccgcgccgagcacaccgggcgggagatcgtcgacctgatgtgccacgccaccttcacgatgcgcctcctgagcccggtgcgggtgcccaactacaacctgatcatcatggacgaggcccacttcaccgaccccgccagcatcgcggcccgcggctacatctccacccgggtcgagatgggcgaggccgccgggatcttcatgaccgccacgcccccgggcagccgcgaccccttcccccagtccaacgcgcccatcatggacgaggagcgggagatcccggagcgcagctggaactccgggcacgagtgggtgaccgacttcaagggcaagaccgtgtggttcgtccccagcatcaaggccgggaacgacatcgccgcctgcctccggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctgacggacggggaggagcgggtcatcctcgccggcccgatgcccgtgacccacagctccgccgcccagcgccgggggcgcatcggccgcaaccccaagaacgagaacgaccagtacatctacatgggggagcccctggagaacgacgaggactgcgcgcactggaaggaggccaagatgctgctcgacaacatcaacaccccggagggcatcatccccagcatgttcgagcccgagcgggagaaggtggacgccatcgacggcgagtaccgcctgcgcggggaggcccgcaagaccttcgtcgacctgatgcggcgcggcgacctcccggtgtggctggcctaccgggtcgcggccgaggggatcaactacgccgaccgccggtggtgcttcgacggcatcaagaacaaccagatcctggaggagaacgtggaggtggagatctggacgaaggagggggagcgcaagaagctcaagccccggtggctggacgcccgcatctactccgaccccctggccctcaaggagttcaaggagttcgcggccggccgcaagagcctgaccctgaacctcatcaccgagatgggccgcctgcccaccttcatgacgcagaaggcccggaacgccctggacaacctcgcggtcctgcacaccgccgaggccgggggccgcgcctacaaccacgccctgtccgagctcccggagaccctggagaccctgctcctgctgacgctcctggcgaccgtgaccgggggcatcttcctgttcctcatgagcggcaaggggatcggcaagatgaccctggggatgtgctgcatcatcaccgcctccatcctgctctggtacgcccagatccagccccactggatcgccgccagcatcatcctggagttcttcctgatcgtgctcctgatccccgagcccgagaagcagcggacgccgcaggacaaccagctgacctacgtcgtgatcgcgatcctcaccgtggtcgccgccaccatggccaacgagatgggcttcctggagaagacgaagaaggacttcgggctgggctccatcgccacccagcagcccgagagcaacatcctcgacatcgacctgcgccccgcgagcgcctggaccctgtacgccgtggccaccacgttcatcacccccatgctccggcactccatcgagaacagctccgtgaacgtcagcctgaccgccatcgcgaaccaggccaccgtgctgatgggcctcgggaagggctggccgctgtccaagatggacatcggggtgcccctgctcgccatcggctgctacagccaggtcaaccccatcacgctgaccgccgcgctgctcctgctggtggcccactacgccatcatcgggcccggcctccaggccaaggccacccgcgaggcgcagaagcgggccgccgccggcatcatgaagaacccgaccgtggacgggatcacggtcatcgacctggaccccatcccctacgaccccaagttcgagaagcagctgggccaggtgatgctcctggtgctgtgcgtcacccaggtgctcatgatgcgcaccacctgggccctgtgcgaggcgctgacgctcgccaccgggccgatctccaccctgtgggagggcaaccccgggcgcttctggaacaccacgatcgccgtgagcatggccaacatcttccggggctcctacctggccggcgcggggctcctgttcagcatcatgaagaacaccaccaacacccgccggggcacggggaacaccggcgagaccctgggcgagaagtggaagaaccgcctcaactccctgggcaagagcgagttccagatctacaagcggtccggcatccaggaggtcgaccgcaccctggccaaggaggggatcaagcggggcgagacggaccaccacgccgtgagccgcgggtccgccaagctccggtggttcgtggagcgcaacctggtcacccccgagggcaaggtggtggacctgggctgcgggcggggcgggtggagctactactgcggcgggctcaagaacgtccgcgaggtgaagggcctgaccaagggcgggcccggccacgaggagccgatccccatgtccacctacgggtggaacctggtgcggctccagagcggcgtcgacgtgttcttcacgccgcccgagaagtgcgacaccctgctgtgcgacatcggggagtccagcccgaaccccaccgtggaggcgggccgcaccctccgggtcctgaacctggtggagaactggctcaacaacaacacccagttctgcatcaaggtgctgaacccctacatgccgagcgtcatcgagaagatggagacgctgcagcgcaagtacggcggggccctggtgcggaaccccctctcccgcaacagcacccacgagatgtactgggtgtccaacgccagcggcaacatcgtctccagcgtgaacatgatctcccggatgctgatcaaccgcttcaccatgcgccacaagaaggccacctacgagcccgacgtggacctggggagcggcacgcggaacatcgggatcgagtccgagacccccaacctcgacatcatcggcaagcgcatcgagaagatcaagcaggagcacgagaccagctggcactacgaccaggaccacccgtacaagacctgggcctaccacggctcctacgagacgaagcagaccgggagcgcgtccagcatggtcaacggcgtggtgcggctgctgaccaagccctgggacgtcatccccatggtgacccagatggccatgacggacaccacccccttcgggcagcagcgcgtgttcaaggagaaggtcgacacccggacgcaggagccgaaggagggcaccaagaagctcatgaagatcaccgccgagtggctgtggaaggagctgggcaagaagaagacgccccggatgtgcacgcgggaggagttcacccgcaaggtgcggtccaacgccgccctcggggcgatcttcaccgacgagaacaagtggaagtccgcccgcgaggccgtcgaggactcccggttctgggagctggtggacaaggagcgcaacctgcacctcgagggcaagtgcgagacctgcgtgtacaacatgatggggaagcgggagaagaagatcggcgagttcgggaaggccaagggcagccgcgccatctggtacatgtggctgggcgcgcggttcctggagttcgaggccctcgggttcctgaacgaggaccactggttctcccgcgagaacagcctgagcggcgtcgagggggagggcctccacaagctggggtacatcctgcgggaggtgtccaagaaggagggcggcgccatgtacgccgacgacacggcggggtgggacacccgcatcaccctcgaggacctgaagaacgaggagatggtgaccaaccacatggagggcgagcacaagaagctggccgaggccatcttcaagctcacgtaccagaacaaggtcgtgcgggtgcagcgccccacgccccgggggaccgtcatggacatcatcagccgccgcgaccagcggggctccggccaggtggggacctacggcctgaacacgttcaccaacatgggggcccagctgatccgccagatggagggcgagggggtgttcaagggcatccagcacctcaccgccaccgaggaggtcgcggtgcaggactggctggcccgggtgggccgcgagcggctgagccgcatggccatctccggggacgactgcgtcgtgaagccgctcgacgaccggttcgccagcgccctgacggcgctgaacgacatgggcaagatccgcaaggacatccagcagtgggagccctcccgggggtggaacgactggacccaggtgcccttctgcagccaccacttccacgagctcatcatgaaggacggccgcgtcctggtggtgccctgccggaaccaggacgagctgatcgggcgcgcccggatctcccagggcgccggctggagcctccgcgagaccgcctgcctggggaagtcctacgcccagatgtggagcctgatgtacttccaccggcgcgacctccggctggcggccaacgccatctgctccgccgtcccgagccactgggtgcccacctcccgcaccacgtggagcatccacgcccggcacgagtggatgaccaccgaggacatgctgaccgtgtggaaccgcgtctggatccaggagaacccctggatggaggacaagacgcccgtggagtcctgggaggagatcccgtacctcggcaagcgcgaggaccagtggtgcgggagcctgatcggcctgaccagccgggcgacctgggccaagaacatccagaccgccatcaaccaggtgcgctccctcatcgggagcgaggagtacacggactacatgccctccatgaagcggttccgccgggaggaggaggaggccggcgtcctgtggtga

SEQ ID NO: 9645 - RNA, 9876 nt, synthetic construct
  misc_feature 1..9876: note = derived and/or modified CDS sequence (opt1) from DENV-2__JX470186__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccacccggggttcaccatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggcgcaccggcagtggttcctcgacctgcccctgccctggctcccgggcgccgacacccaggggtccaactggatccagaaggagaccctggtgacgttcaagaacccccacgccaagaagcaggacgtcgtggtcctgggcagccaggagggggccatgcacaccgccctcaccggcgcgaccgagatccagatgagctccgggaacctgctgttcacgggccacctcaagtgccgcctgcggatggacaagctgcagctcaagggcatgagctactccatgtgcaccgggaagttcaaggtggtgaaggagatcgccgagacccagcacggcaccatcgtcatccgcgtgcagtacgagggggacggcagcccctgcaagatccccttcgagatcatggacctggagaagcggcacgtgctgggccgcctcatcacggtcaacccgatcgtgaccgagaaggactcccccgtgaacatcgaggccgagccgcccttcggggacagctacatcatcatcggcgtcgagccggggcagctgaagctgtcctggttcaagaagggcagctccatcgggcagatgttcgagaccaccatgcgcggcgccaagcggatggccatcctcggcgacacggcgtgggacttcgggagcctgggcggggtgttcacctccatcggcaaggccctgcaccaggtgttcggggccatctacggcgccgcgttcagcggcgtctcctggaccatgaagatcctcatcggggtggtgatcacctggatcggcatgaacagccgctccacgagcctgtccgtcagcctggtgctggtgggggtcgtgaccctctacctgggcgtgatggtccaggccgactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggcggggaagcggagcctccgcccgcagcccaccgagctgaagtactcctggaaggcctggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagatgaaggagcgccaggacgtgttctgcgacagcaagctgatgtccgcggccatcaaggacagccgggccgtccacgccgacatggggtactggatcgagtccgccctgaacgacacgtggaagatcgagaaggcgagcttcatcgaggtgaagtcctgccactggcccaagagccacaccctctggtccaacggcgtgctggagagcgagatgatcatccccaagaacttcgccggccccgtcagccagcacaactaccgcccggggtaccacacccagaccgccggcccctggcacctggggcggctcgagatggacttcgacttctgcgagggcaccacggtggtggtcaccgaggactgcgggaaccgcggcccctccctgcggaccaccacggccagcggcaagctgatcaccgagtggtgctgccgctcctgcaccctgccgcccctgcggtaccgcggggaggacggctgctggtacgggatggagatccggcccctgaaggagaaggaggagaacctcgtgaacagcctggtgaccgcgggccacgggcagatcgacaacttctccctgggcgtcctcggcatggccctgttcctggaggagatgctccgcacgcgggtggggaccaagcacgccatcctgctggtggccgtcagcttcgtgaccctcatcaccggcaacatgtccttccgcgacctggggcgcgtgatggtcatggtgggcgccacgatgaccgacgacatcgggatgggcgtgacctacctggcgctcctggccgccttcaaggtccggcccaccttcgccgccggcctgctcctgcgcaagctgacgagcaaggagctcatgatgaccaccatcgggatcgtgctgctgtcccaggcgaccatccccgagacgatcctcgagctgaccgacgccctggccctcggcatgatggtgctgaagatcgtccggaacatggagaagtaccagctggccgtgaccatcatggccatcctctgcgtccccaacgcggtgatcctgcagaacgcctggaaggtgagctgcaccacgctggccgtcgtgtccgtgagccccctcctgctgacctccagccagcagaaggccgactggatccccctcgcgctgaccatcaaggggctgaaccccaccgccatcttcctcacgaccctgtcccgcaccaacaagaagcggagctggccgctgaacgaggccatcatggccgtcggcatggtgtccatcctcgccagctccctgctgaagaacgacatccccatgaccggccccctcgtggccggcgggctgctgacggtctgctacgtgctcaccgggcgcagcgccgacctggagctggagcgggccgccgacgtgcgctgggaggagcaggccgagatcagcgggtccagccccatcctctccatcaccatcagcgaggacgggtccatgagcatcaagaacgaggaggaggagcagaccctgacgatcctgatccggaccggcctcctggtcgtgtccggcctgttcccggtgagcacccccatcaccgcggccgcctggtacctctgggaggtcaagaagcagcgcgccggggtgctgtgggacgtgcccagcccgccgcccgtcggcaaggccgagctggaggacggggcgtaccggatcaagcagaagggcatcctcgggtacagccagatcggcgccggcgtgtacaaggaggggaccttccacacgatgtggcacgtgacccgcggcgccgtcctgatgcacaaggggaagcggatcgagccctcctgggccgacgtgaagaaggacctgatcagctacggcgggggctggaagctcgagggcgagtggaaggagggggaggaggtgcaggtcctggccctggagcccggcaagaacccccgcgcggtgcagaccaagcccggcctcttcaagaccaacacgggcaccatcggggccgtgtccctggacttcagccccggcacctccggcagccccatcgtcgacaagaaggggaaggtggtgggcctgtacgggaacggcgtcgtgacccggtccggcacgtacgtgagcgccatcgcccagaccgagaagtccatcgaggacaaccccgagatcgaggacgacatcttccgcaagaagcggctcaccatcatggacctgcaccccggggcgggcaagaccaagcgctacctgcccgccatcgtccgggaggccatcaagcgcgggctgcggacgctcatcctggccccgacccgcgtggtggccgcggagatggaggaggccctgcgcggcctccccatccggtaccagacccccgccatccgcgccgagcacaccgggcgggagatcgtcgacctgatgtgccacgccacgttcaccatgcgcctgctcagccccatccgggtgccgaactacaacctgatcatcatggacgaggcgcacttcaccgaccccgccagcatcgccgcccgcggctacatctccacccgggtggagatgggcgaggccgcggggatcttcatgacggccacgccgcccggcagccgcgacccgttcccccagtccaacgcccccatcatggacgaggagcgggagatccccgagcgcagctggaactccgggcacgagtgggtcaccgacttcaagggcaagaccgtgtggttcgtgccgagcatcaaggccgggaacgacatcgcggcctgcctgcggaagaacggcaagaaggtcatccagctctcccgcaagacgttcgacagcgagtacatcaagacccggaccaacgactgggacttcgtggtgaccacggacatctccgagatgggcgccaacttcaaggccgagcgcgtcatcgacccccggcgctgcatgaagcccgtgatcctgaccgacggggaggagcgggtgatcctggccggccccatgccggtcacccacagctccgcggcccagcgccgggggcgcgtgggccgcaaccccaagaacgagaacgaccagtacatctacatgggggagcccctcgagaacgacgaggactgcgcccactggaaggaggccaagatgctgctggacaacatcaacacccccgagggcatcatcccgagcatgttcgagcccgagcgggagaaggtggacgccatcgacggcgagtaccgcctccgcggggaggcgcgcaagacgttcgtcgacctgatgcggcgcggcgacctgcccgtgtggctcgcctaccgggtcgccgccgaggggatcaactacgccgaccgccggtggtgcttcgacggcgtgaagaacaaccagatcctggaggagaacgtggaggtcgagatctggaccaaggagggggagcgcaagaagctgaagccgcggtggctcgacgcgcgcatctactccgaccccctggccctgaaggagttcaaggagttcgccgccggccgcaagagcctcaccctgaacctgatcaccgagatgggccggctccccacgttcatgacccagaaggcgcggaacgccctggacaacctggccgtgctccacaccgccgaggccgggggccgcgcgtacaaccacgccctgtccgagctgcccgagaccctcgagacgctgctgctcctgaccctgctcgccaccgtgaccgggggcatcttcctgttcctgatgagcggcaaggggatcggcaagatgaccctcgggatgtgctgcatcatcacggcctccatcctgctgtggtacgcccagatccagccgcactggatcgcggccagcatcatcctcgagttcttcctgatcgtcctgctcatccccgagcccgagaagcagcggacgccccaggacaaccagctgacctacgtggtgatcgccatcctgaccgtcgtggccgccacgatggcgaacgagatgggcttcctcgagaagaccaagaaggacttcgggctgggctccatcaccacccagcagccggagaacaacatcctggacatcgacctccgccccgccagcgcctggacgctgtacgccgtggccaccaccttcatcacccccatgctgcggcacagcatcgagaactccagcgtcaacgtgtccctcacggcgatcgccaaccaggccaccgtgctgatgggcctggggaagggctggcccctcagcaagatggacatcggggtcccgctgctggccatcggctgctactcccaggtgaaccccatcaccctcaccgcggccctgctgctcctggtggcccactacgccatcatcgggcccggcctgcaggccaaggcgacgcgcgaggcccagaagcgggccgccgccggcatcatgaagaaccccaccgtcgacgggatcaccgtgatcgacctcgacccgatcccctacgaccccaagttcgagaagcagctgggccaggtgatgctgctcgtcctgtgcgtgacccaggtgctgatgatgcgcacgacctgggcgctctgcgaggccctgaccctggccaccgggcccatcagcacgctctgggagggcaacccggggcgcttctggaacaccaccatcgccgtctccatggccaacatcttccggggcagctacctggcgggcgccgggctcctcttctccatcatgaagaacaccgccaacacgcgccggggcaccgggaacaccggcgagaccctgggcgagaagtggaagaaccgcctgaacgccctcgggaagtccgagttccagatctacaagaagtccggcatccaggaggtggaccggacgctggcgaaggaggggatcaagcgcggcgagaccgaccaccacgccgtgagccgggggtccgccaagctgcgctggttcgtcgagcggaacctcgtgacccccgagggcaaggtggtcgacctgggctgcgggcgcggcgggtggagctactactgcggcgggctgaagaacgtgaaggaggtgaagggcctcaccaagggcgggcccggccacgaggagcccatcccgatgtccacgtacgggtggaacctggtccggctgcagagcggcgtggacgtgttcttcacgccgcccgagaagtgcgacaccctcctgtgcgacatcggggagtccagccccaacccgaccgtcgaggccggccgcaccctgcgggtgctcaacctggtggagaactggctgaacaacaacacgcagttctgcatcaaggtcctcaacccctacatgccctccgtgatcgagaagatggaggccctgcagcgcaagtacggcggggcgctggtgcggaacccgctgagccgcaacagcacccacgagatgtactgggtctccaacgccagcggcaacatcgtgtccagcgtgaacatgatctcccggatgctcatcaaccgcttcaccatgcggcacaagaaggccacctacgagcccgacgtcgacctggggagcggcacgcgcaacatcgggatcgagtccgagacccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtggtccggctcctgaccaagccgtgggacgtgatccccatggtgacccagatggcgatgacggacaccacccccttcgggcagcagcgcgtcttcaaggagaaggtggacacccggacgcaggagcccaaggagggcaccaagaagctgatgaagatcaccgccgagtggctctggaaggagctgggcaagaagaagaccccgcgcatgtgcacgcgggaggagttcacccgcaaggtccggtccaacgccgccctgggggccatcttcaccgacgagaacaagtggaagtccgcgcgcgaggccgtggaggactccggcttctgggagctcgtggacaaggagcggaacctgcacctggaggggaagtgcgagacctgcgtctacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgtccggggtggagggcgaggggctccacaagctgggctacatcctgcgcgacgtgagcaagaaggagggcggggccatgtacgccgacgacacggccggctgggacacccggatcaccctcgaggacctgaagaacgaggagatggtcaccaaccacatggagggggagcacaagaagctggcggaggccatcttcaagctcacgtaccagaacaaggtggtgcgcgtccagcggcccacgccccgcggcaccgtgatggacatcatcagccggcgcgaccagcgggggtccggccaggtggtcacctacggcctgaacaccttcaccaacatggaggcccagctgatccgccagatggagggggagggcgtgttcaagagcatccagcagctcaccgtgaccgaggagatcgccgtcaagaactggctggtgcgcgtggggcgggagcgcctgtcccggatggccatcagcggcgacgactgcgtcgtgaagcccctcgacgaccgcttcgcgtccgccctgacggccctgaacgacatgggcaaggtgcggaaggacatccagcagtgggagccgagccgcgggtggaacgactggacccaggtccccttctgctcccaccacttccacgagctcatcatgaaggacggccgggtgctggtggtcccctgccgcaaccaggacgagctgatcgggcgggcccgcatcagccagggcgccgggtggtccctccgggagaccgcgtgcctgggcaagagctacgcccagatgtggtccctgatgtacttccaccgccgggacctccgcctggccgccaacgccatctgcagcgcggtgccctcccactgggtgccgaccagccggaccacgtggtccatccacgccacccacgagtggatgaccaccgaggacatgctgacggtctggaaccgcgtgtggatccaggagaacccctggatggaggacaagacccccgtggagagctgggaggagatcccctacctcggcaagcgggaggaccagtggtgcgggtccctgatcggcctgaccagccgcgccacctgggccaagaacatccagacggcgatcaaccaggtccggagcctcatcgggaacgaggagtacaccgactacatgccgtccatgaagcgcttccgccgggaggaggaggaggccggcgtgctgtggtga

SEQ ID NO: 9646 - RNA, 9876 nt, synthetic construct
  misc_feature 1..9876: note = derived and/or modified CDS sequence (opt1) from DENV-2__KU517846__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgaccgccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcgggatcgtgaccctctacctgggcgtgatggtccaggcggactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtcgaggactacgggttcggcgtgttcaccaccaacatctggctcaagctgaaggagcgccaggacgtgttctgcgacagcaagctgatgtccgccgcgatcaaggacaaccgggccgtccacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcaccacggtggtggtcaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgaccgccggccacgggcagatcgacaacttcagcctcggcgtcctgggcatggcgctgttcctcgaggagatgctgcgcacgcgggtggggaccaagcacgccatcctgctcgtggccgtctccttcatgaccctgatcaccggcaacatgagcttccgcgacctggggcgcgtgatggtgatggtcggcgccacgatgaccgacgacatcgggatgggcgtgacctacctcgccctgctggcggccttcaaggtgcggcccaccttcgccgccggcctcctgctgcgcaagctcacgtccaaggagctgatgatgaccaccatcgggatcgtcctgctcagccagtccaccatccccgagacgatcctggagctgaccgacgccctcgcgctgggcatgatggtgctgaagatcgtgcggaacatggagaagtaccagctcgccgtcaccatcatggccatcctgtgcgtgccgaacgccgtcatcctgcagaacgcctggaaggtgagctgcaccatcctcgcggtggtctccgtgagccccctgctgctcacgtccagccagcagaaggccgactggatccccctggccctgaccatcaaggggctcaaccccaccgccatcttcctgaccacgctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcaccgtgtgctacgtcctgacggggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagctgaccctcaccatcctgatccggacgggcctgctcgtgatcagcggcctgttcccggtctccatccccatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtactcccagatcggcgccggcgtgtacaaggaggggaccttccacaccatgtggcacgtcacccgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccccgcgccgtgcagacgaagcccgggctgttcaagaccaacaccggcaccatcggggccgtcagcctcgacttctcccccggcacgagcggctcccccatcgtggacaagaaggggaaggtggtcggcctgtacgggaacggcgtggtgacccggagcggcacctacgtctccgcgatcgcccagaccgagaagtccatcgaggacaaccccgagatcgaggacgacatcttccgcaagaagcggctgacgatcatggacctgcaccccggggccggcaagaccaagcgctacctccccgccatcgtgcgggaggcgatcaagcgcgggctgcggaccctgatcctcgccccgacccgcgtggtcgccgccgagatggaggaggccctgcgcggcctgcccatccggtaccagacgcccgcgatccgcgccgagcacaccgggcgggagatcgtggacctcatgtgccacgccaccttcaccatgcgcctgctgagccccatccgggtgccgaactacaacctcatcatcatggacgaggcccacttcacggaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgacggacttcaagggcaagaccgtgtggttcgtcccgtccatcaaggccgggaacgacatcgccgcctgcctgcggaagaacggcaagaaggtgatccagctgagccgcaagaccttcgactccgagtacatcaagacccggacgaacgactgggacttcgtggtcaccaccgacatcagcgagatgggcgcgaacttcaaggccgagcgcgtgatcgacccccggcgctgcatgaagcccgtgatcctcaccgacggggaggagcgggtcatcctggccggccccatgccggtgacgcactccagcgccgcccagcgccgggggcgcgtgggccgcaaccccaagaacgagaacgaccagtacatctacatgggggagcccctggagaacgacgaggactgcgcgcactggaaggaggccaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtgtggctggcctaccgggtcgcggccgaggggatcaactacgccgaccgccggtggtgcttcgacggcgtgaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgcggccggccggaagtccctgacgctcaacctgatcaccgagatgggccgcctgcccaccttcatgacccagaaggcccggaacgccctcgacaacctggcggtgctgcacacggccgaggccgggggccgcgcctacaaccacgccctcagcgagctgcccgagaccctggagaccctcctgctgctcaccctgctggcgacggtcaccgggggcatcttcctcttcctgatgtccggcaaggggatcggcaagatgaccctggggatgtgctgcatcatcaccgccagcatcctcctgtggtacgcccagatccagccgcactggatcgccgcctccatcatcctggagttcttcctcatcgtgctgctgatccccgagcccgagaagcagcggacgccccaggacaaccagctcacgtacgtggtcatcgcgatcctgaccgtggtggccgccaccatggccaacgagatgggcttcctggagaagaccaagaaggacttcgggctcggcagcatcacgacccagcagccggagagcaacatcctggacatcgacctgcgccccgcctccgcgtggaccctctacgccgtcgccaccacgttcatcacccccatgctgcggcacagcatcgagaactccagcgtgaacgtgtccctgaccgccatcgccaaccaggcgaccgtcctcatgggcctggggaagggctggcccctgagcaagatggacatcggggtgccgctcctggccatcggctgctactcccaggtgaaccccatcacgctgaccgccgccctcctgctgctcgtcgcgcactacgccatcatcgggcccggcctgcaggccaaggccacccgcgaggcccagaagcgggcggccgccggcatcatgaagaaccccaccgtggacgggatcacggtgatcgacctggacccgatcccctacgaccccaagttcgagaagcagctcggccaggtcatgctgctggtgctctgcgtgacccaggtcctgatgatgcgcaccacctgggccctgtgcgaggccctcacgctggcgaccgggcccatcagcaccctgtgggagggcaacccggggcgcttctggaacaccacgatcgccgtgtccatggccaacatcttccggggcagctacctcgccggcgccgggctgctgttctccatcatgaagaacaccgcgaacacccgccggggcaccgggaacacgggcgagaccctcggcgagaagtggaagaaccgcctgaacgccctgggcaagagcgagttccagatctacaagaagtccggcatccaggaggtggaccggaccctcgccaaggaggggatcaagcgcggcgagaccgaccaccacgccgtcagccgggggtccgcgaagctgcgctggttcgtggagcggaacctggtgacgcccgagggcaaggtcgtggacctcggctgcgggcgcggcgggtggagctactactgcggcgggctgaagaacgtgaaggaggtcaagggcctgaccaagggcgggcccggccacgaggagcccatcccgatgtccacctacgggtggaacctcgtgcggctgcagagcggcgtggacgtcttcttcacgccgcccgagaagtgcgacacgctgctctgcgacatcggggagtccagccccaacccgaccgtggaggccggccgcaccctgcgggtgctgaacctcgtcgagaactggctgaacaacaacacccagttctgcatcaaggtgctgagcccctacatgccctccgtgatcgagaagatggaggccctgcagcgcaagtacggcggggccctcgtccggaacccgctgagccgcaactccacccacgagatgtactgggtgagcaacgcctccggcaacatcgtgagctccgtcaacatgatcagccggatgctgatcaaccgcttcacgatgcggcacaagaaggcgacctacgagcccgacgtggacctcgggtccggcacccgcaacatcgggatcgagagcgagacccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtcgtgcggctgctcacgaagccgtgggacgtgatccccatggtcacccagatggccatgaccgacaccacgcccttcgggcagcagcgcgtgttcaaggagaaggtggacacccggacccaggagcccaaggagggcaccaagaagctgatgaagatcacggccgagtggctgtggaaggagctcggcaagaagaagaccccgcgcatgtgcacccgggaggagttcacccgcaaggtccggagcaacgcggccctgggggccatcttcacggacgagaacaagtggaagtccgcccgcgaggccgtggaggacagcggcttctgggagctggtcgacaaggagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaacagcctgtccggggtggagggcgaggggctgcacaagctcggctacatcctgcgcgacgtcagcaagaaggagggcggggcgatgtacgccgacgacaccgccggctgggacacccggatcacgctggaggacctcaagaacgaggagatggtgaccaaccacatggagggggagcacaagaagctggccgaggccatcttccgcctgacctaccagaacaaggtggtccgggtgcagcgccccacgccccggggcacggtgatggacatcatctcccgccgggaccagcgcgggagcggccaggtcgtgacctacggcctcaacaccttcaccaacatggaggcgcagctgatccgccagatggagggggagggcgtgttcaagtccatccagcacctgacggtcaccgaggagatcgccgtgaagaactggctcgagcgggtggggcgcgagcggctgagccgcatggccatctccggcgacgactgcgtcgtgaagcccctggacgaccggttcgccagcgccctcaccgcgctgaacgacatgggcaagatccgcaaggacatccagcagtgggagccgtcccgggggtggaacgactggacccaggtgcccttctgcagccaccacttccacgagctgatcatgaaggacggccgcgtcctcgtggtgccctgccggaaccaggacgagctgatcgggcgcgcccggatctcccagggcgccgggtggagcctgcgcgagacggcctgcctcggcaagtcctacgcccagatgtggagcctgatgtacttccaccggcgcgacctgcggctcgcggccaacgccatctgctccgccgtccccagccactgggtgccgacctcccgcaccacctggagcatccacgccacccacgagtggatgacgaccgaggacatgctgaccgtgtggaaccgggtctggatccaggagaacccctggatggaggacaagacccccgtggagagctgggaggagatcccctacctgggcaagcgcgaggaccagtggtgcgggtccctcatcggcctgacgagccgggcgacctgggccaagaacatccagaccgccatcaaccaggtgcgctccctgatcgggaacgaggagtacaccgactacatgccgagcatgaagcgcttccggcgcgaggaggaggaggccggcgtcctctggtga

SEQ ID NO: 9647 - RNA, 9876 nt, synthetic construct
  misc_feature 1..9876: note = derived and/or modified CDS sequence (opt1) from DENV-2__KJ830750__SS-prME
  source 1..9876: mol_type = other RNA
accgccggcgtgatcatcatgctgatccccaccgccatggcgttccacctcaccacccggaacggggagccccacatgatcgtgtccaagcaggagaagggcaagtccctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccgccgggagaagcggagcgtcgccctggtgccccacgtgggcatggggctcgagacccggaccgagacctggatgtccagcgagggcgcctggaagcacgcgcagcgcatcgagacctggatcctgcggcaccccgggttcacgatcatggccgccatcctggcctacaccatcggcaccacctacttccagcgcgtcctcatcttcatcctgctgacggcggtggccccctccatgaccatgcggtgcatcgggatcagcaaccgcgacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccggaagtactgcatcgaggcgaagctgaccaacacgaccaccgccagccgctgcccgacccagggggagccctccctgaacgaggagcaggacaagcggttcgtgtgcaagcacagcatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctcgacttcaacgagatggtgctgctgcagatggagaacaaggcgtggctcgtgcaccgccagtggttcctggacctgcccctcccctggctgccgggcgccgacatccaggggtccaactggatccagaaggagaccctggtcaccttcaagaacccccacgccaagaagcaggacgtggtcgtgctcggcagccaggagggggccatgcacacggccctgaccggcgcgaccgagatccagatgagctccgggaacctgctgttcaccggccacctgaagtgccggctgcgcatggacaagctccagctgaagggcatgagctactccatgtgcacggggaagttcaaggtggtcaaggagatcgccgagacccagcacggcaccatcgtggtgcgggtccagtacgagggggacggcagcccctgcaagatccccttcgagatcatggacctggagaagcgccacgtgctcggccggctgatcaccgtgaacccgatcgtcacggggaaggactcccccgtgaacatcgaggccgagccgcccttcggcgacagctacatcatcatcggggtggagccgggccagctgaagctctcctggttcaagaaggggagctccatcggccagatgttcgagaccaccatgcgcggcgccaagcgcatggccatcctgggggacaccgcgtgggacttcggcagcctcggcggggtcttcacgtccatcgggaaggccctccaccaggtgttcggggccatctacggcgccgcgttcagcggggtgtcctggaccatgaagatcctgatcggcgtcgtgatcacctggatcgggatgaacagccggtccaccagcctgtccgtgagcctggtcctcgtgggcgtggtcacgctgtacctgggggtgatggtgcaggccgactccggctgcgtcgtgagctggaagaacaaggagctcaagtgcggcagcgggatcttcatcaccgacaacgtgcacacctggaccgagcagtacaagttccagcccgagtcccccagcaagctggcctccgccatccagaaggcccacgaggagggcatctgcgggatccgcagcgtcacgcggctggagaacctcatgtggaagcagatcacccccgagctgaaccacatcctgtccgagaacgaggtgaagctcagcatcatgaccggcgacatcaaggggatcatgcaggcgggcaagcgctccctgcggccgcagcccaccgagctgaagtacagctggaagacgtggggcaaggccaagatgctctccaccgagccccacaaccagaccttcctgatcgacgggccggagaccgccgagtgccccaacacgaaccgcgcctggaacagcctggaggtggaggactacggcttcggggtcttcaccaccaacatctggctcaagctgaaggagcggcaggacgtgtcctgcgacagcaagctgatgtccgccgcgatcaaggacaaccgcgccgtgcacgccgacatgggctactggatcgagagcgccctcaacgacacctggaagatcgagaaggcctccttcatcgaggtcaagagctgccactggcccaagtcccacacgctgtggagcaacggcgtgctggagagcgagatgatcatccccaagaacttcgcggggccggtgtcccagcacaactaccggcccggctaccacacccagaccgccgggccctggcacctcggcaagctggagatggacttcgacttctgcgaggggaccaccgtcgtggtgacggaggactgcggcaaccgcggccccagcctgcggaccaccaccgcctccgggaagctcatcacggagtggtgctgccgcagctgcaccctgccgcccctgcggtaccgcggcgaggacgggtgctggtacggcatggagatccggcccctcaaggagaaggaggagaacctggtcaactccctggtgaccgccgggcacggccagatcgacaacttcagcctcggcgtgctggggatggcgctgttcctcgaggagatgctgcgcacccgggtcggcacgaagcacgccgtgctgctcgtggccgtctccttcatgaccctgatcaccgggaacatgagcttccgcgacctgggccgggtgatggtgatggtcggggccgccatgaccgacgacatcggcatgggcgtgacgtacctcgcgctgctggccgccttcaaggtgcgccccaccttcgccgccgggctcctgctgcgcaagctcacctccaaggagctgatgatgaccacgatcggcatcgtcctgctcagccagtccaccaccccggagagcatcctggagctgaccgacgcgctcgccctggggatgatgatcctgaagatcgtgcggaacatggagaagtaccagctcgccgtcacgatcatggccatcctgtgcgtgcccaacgccgtgatcctgcagaacgcgtggaaggtctcctgcaccatcctcgccgccgtgagcgtgagccccctgctgctcaccagctcccagcagaaggccgactggatccccctggcgctgaccatcaagggcctcaacccgacggccatcttcctgaccaccctgagccgcaccaacaagaagcggtcctggcccctcaacgaggccatcatggccgtcggcatggtgagcatcctggccagctccctgctcaagaacgacatccccatgacggggcccctggtggcgggcgggctgctcaccgtctgctacgtgctgaccggccgcagcgccgacctggagctcgagaaggccgccgacgtgcggtgggaggaccaggccgagatctccgggagctccccgatcctgagcatcaccatctccgaggacggcagcatgtccatcaagaacgaggaggaggagcagacgctgaccatcctcatccgcaccggcctgctggtcatcagcggcctcttccccgtgtccatccccatcaccgcggccgcctggtacctgtgggaggtgaagaagcagcgggccggcgtcctgtgggacgtgcccagcccgccgcccgtggggaaggccgagctcgaggacggcgcgtaccgcatcaagcagaaggggatcctgggctactcccagatcggcgccggggtctacaaggagggcacgttccacaccatgtggcacgtgacccgcggggccgtgctgatgcacaagggcaagcgcatcgagccgagctgggccgacgtccggaaggacctcatctcctacgggggcggctggaagctggagggggagtggaaggagggcgaggaggtccaggtgctggccctcgagcccgggaagaacccccgcgcggtccagaccaagcccggcctgttcaagaccaacacggggaccatcggcgccgtgagcctggacttctccccgggcaccagcgggtcccccatcgtggacaagaagggcaaggtcgtggggctctacggcaacggcgtggtcacccggagcgggacgtacgtgagcgccatcgcccagaccgagaagtccatcgaggacaaccccgagatcgaggacgacatcttccgcaagaagcggctgaccatcatggacctgcaccccggcgcggggaagaccaagcgctacctgccggccatcgtgcgggaggccatcaagcgcggcctccggacgctgatcctggcccccacccgcgtcgtggccgcggagatggaggaggccctccgggggctgcccatccgctaccagacccccgccatccgcgccgagcacaccggccgggagatcgtggacctgatgtgccacgccacgttcaccatgcgcctcctgagcccggtccgggtgcccaactacaacctgatcatcatggacgaggcgcacttcaccgaccccgcctccatcgccgcccgcggctacatcagcacccgggtggagatgggggaggccgcgggcatcttcatgacggccacgccgcccgggtcccgcgaccccttcccccagagcaacgcccccatcatggacgaggagcgggagatccccgagcgctcctggaacagcggccacgagtgggtcaccgacttcaaggggaagaccgtgtggttcgtgccctccatcaaggccggcaacgacatcgcggcctgcctccggaagaacggcaagaaggtcatccagctgagccgcaagacgttcgactccgagtacatcaagacccggaccaacgactgggacttcgtggtgaccacggacatcagcgagatgggggccaacttcaaggccgagcgcgtcatcgacccccggcgctgcatgaagcccgtgatcctgaccgacggcgaggagcgggtgatcctcgccgggccgatgcccgtcacccactccagcgcggcccagcgccggggccgcatcgggcggaaccccaagaacgagaacgaccagtacatctacatgggcgagcccctggagaacgacgaggactgcgcccactggaaggaggccaagatgctgctcgacaacatcaacaccccggagggcatcatcccctccatgttcgagcccgagcgcgagaaggtggacgccatcgacggggagtaccgcctgcggggcgaggcgcgcaagacgttcgtggacctgatgcggcgcggggacctcccggtctggctggcctaccgggtggccgccgagggcatcaactacgccgaccgccggtggtgcttcgacgggatcaagaacaaccagatcctggaggagaacgtcgaggtggagatctggaccaaggagggcgagcgcaagaagctcaagccccggtggctggacgcgcgcatctacagcgaccccctggccctcaaggagttcaaggagttcgccgccggccggaagtccctgaccctgaacctcatcaccgagatggggcgcctgcccacgttcatgacccagaaggcgcggaacgccctggacaacctcgccgtgctgcacaccgccgaggccggcgggcgcgcgtacaaccacgccctgagcgagctcccggagaccctggagacgctgctcctgctgaccctcctggccaccgtcaccggcggcatcttcctgttcctcatgtccgggaagggcatcgggaagatgacgctgggcatgtgctgcatcatcaccgccagcatcctgctctggtacgcccagatccagccccactggatcgcggccagcatcatcctggagttcttcctgatcgtgctcctgatccccgagcccgagaagcagcggaccccgcaggacaaccagctgacctacgtggtcatcgccatcctcaccgtggtggccgccacgatggcgaacgagatggggttcctggagaagaccaagaaggacttcggcctgggctccatcgccatccagcagcccgagagcaacatcctcgacatcgacctgcgccccgcctccgcctggaccctgtacgccgtcgcgaccacgttcatcacccccatgctccggcacagcatcgagaactccagcgtgaacgtgtccctgaccgccatcgccaaccaggccaccgtcctgatggggctcggcaaggggtggccgctgagcaagatggacatcggcgtgcccctgctcgcgatcgggtgctactcccaggtgaaccccatcacgctgaccgccgccctgctcctgctggtcgcccactacgccatcatcggccccggcctccaggcgaaggccacccgcgaggcccagaagcgggccgccgcggggatcatgaagaacccgaccgtggacggcgtgacggtcatcgacctggaccccatcccctacgaccccaagttcgagaagcagctgggccaggtgatgctcctggtgctgtgcgtcacccaggtgctcatgatgcgcaccacctgggccctgtgcgaggccctgacgctcgccaccggcccgatcagcaccctgtgggaggggaaccccggccggttctggaacaccacgatcgccgtgtccatggcgaacatcttccgcggcagctacctggccggggccggcctcctgttctccatcatgaagaacaccaccaacacccgccgggggacgggcaacaccggcgagaccctgggggagaagtggaagaaccgcctcaacagcctgggcaagtccgagttccagatctacaagcggagcgggatccaggaggtcgaccgcaccctggccaaggagggcatcaagcgcggggagacggaccaccacgcggtgtcccgcggcagcgccaagctccggtggttcgtggagcgcaacctggtcacccccgagggcaaggtggtggacctggggtgcggccgcggcgggtggtcctactactgcggcgggctcaagaacgtccgcgaggtgaaggggctgaccaagggcgggcccgggcacgaggagccgatccccatgagcacctacggctggaacctggtgcggctccagagcggggtcgacgtgttcttcacgccgcccgagaagtgcgacaccctgctgtgcgacatcggcgagtccagcccgaaccccaccgtggaggccggccgcaccctccgggtcctgaacctggtggagaactggctcaacaacaacacgcagttctgcatcaaggtgctgaacccctacatgccgtccgtcatcgagaagatggagaccctgcagcgcaagtacgggggcgccctggtgcggaaccccctcagccgcaactccacccacgagatgtactgggtgagcaacgcctccgggaacatcgtcagctccgtgaacatgatcagccggatgctgatcaaccgcttcaccatgcggcacaagaaggcgacctacgagcccgacgtggacctgggctccgggacgcgcaacatcggcatcgagagcgagacccccaacctcgacatcatcggcaagcgcatcgagaagatcaagcaggagcacgagacctcctggcactacgaccaggaccacccgtacaagacctgggcctaccacgggagctacgagacgaagcagaccggctccgccagctccatggtcaacggggtggtgcggctgctgaccaagccctgggacgtcatccccatggtgacccagatggccatgacggacaccacccccttcggccagcagcgcgtgttcaaggagaaggtcgacacccggacgcaggagccgaaggagggcaccaagaagctcatgaagatcaccgccgagtggctgtggaaggagctggggaagaagaagacgccccggatgtgcacgcgggaggagttcgcgcgcaaggtgcggagcaacgccgccctcggcgccatcttcaccgacgagaacaagtggaagtccgcccgcgaggcggtcgaggacagccggttctgggagctggtggacaaggagcgcaacctgcacctcgaggggaagtgcgagacctgcgtgtacaacatgatgggcaagcgggagaagaagatcggggagttcggcaaggccaagggcagccgcgccatctggtacatgtggctgggggcccggttcctggagttcgaggcgctcggcttcctgaacgaggaccactggttctcccgcgagaacagcctgtccggggtcgagggcgaggggctccacaagctgggctacatcctgcgggaggtgagcaagaaggagggcggggccatgtacgccgacgacaccgccggctgggacacgcgcatcaccctcgaggacctgaagaacgaggagatggtgaccaaccacatggagggggagcacaagaagctggccgaggcgatcttcaagctcacctaccagaacaaggtcgtgcgggtgcagcgccccacgccccggggcaccgtcatggacatcatctcccgccgggaccagcgcgggagcggccaggtgggcacctacgggctgaacaccttcacgaacatgggcgcccagctgatccgccagatggagggggagggcgtgttcaagggcatccagcacctcaccgccaccgaggaggtcgccgtgcaggactggctggcccgggtggggcgcgagcggctgtcccgcatggcgatcagcggcgacgactgcgtcgtgaagccgctcgacgaccggttcgcctccgccctgaccgccctgaacgacatggggaaggtgcgcaaggacatccagcagtgggagcccagccggggctggaacgactggacgcaggtccccttctgctcccaccacttccacgagctcatcatgaaggacgggcgcgtgctggtggtcccctgccggaaccaggacgagctgatcggccgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccgtcccactgggtgcccaccagccgcaccacgtggagcatccacgccgggcacgagtggatgaccaccgaggacatgctgaccgtctggaaccgggtgtggatccaggagaacccctggatggaggacaagacccccgtggagtcctgggaggagatcccgtacctcggcaagcgcgaggaccagtggtgcgggagcctgatcggcctgacgtcccgggccacctgggcgcgcaacatccagaccgccatcaaccaggtccgcagcctcatcggctccgaggagtacaccgactacatgcccagcatgaagcggttccgccgggaggaggaggaggccggggtgctgtggtga

SEQ ID NO: 9648 - RNA, 9876 nt, synthetic construct
  misc_feature 1..9876: note = derived and/or modified CDS sequence (opt1) from DENV-2__FM210231__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtggtgctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatcaaggcggagcacacggggcgggagatcgtcgacctcatgtgccacgccaccttcaccatgcgcctgctgagccccgtgcgcgtgccgaactacaacctcatcatcatggacgaggcccacttcaccgaccccgcctccatcgccgcgcggggctacatcagcacgcgcgtcgagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtgtggttcgtcccgagcatcaaggcggggaacgacatcgccgcctgcctgcgcaagaacggcaagaaggtgatccagctgtcccggaagaccttcgacagcgagtacgtgaagacccgcaccaacgactgggacttcgtcgtgacgaccgacatctccgagatgggcgccaacttcaaggcggagcgggtgatcgacccccgccggtgcatgaagcccgtcatcctcaccgacggggaggagcgcgtgatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtcgacgccatcgacggcgagtaccgcctgcgcggggaggcccgcaagaccttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtgctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatgggcttcctggagaagaccaagaaggacctcgggctgggctccatcgtgacgcagcagccggagagcaacatcctggacatcgacctccggcccgcctccgcctggaccctgtacgccgtcgcgaccaccttcgtgacgcccatgctgcgccacagcatcgagaacagctccgtgaacgtcagcctcaccgccatcgccaaccaggccaccgtgctgatgggcctggggaagggctggcccctctccaagatggacatcggggtgccgctgctggccatcggctgctacagccaggtcaaccccatcaccctcacggcggccctgctgctcctggtggcccactacgccatcatcgggcccggcctgcaggcgaaggccacccgggaggcccagaagcgcgccgccgcgggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcggaccacctgggccctctgcgaggccctgaccctggccacggggcccatctccaccctctgggagggcaacccggggcgcttctggaacaccaccatcgccgtgagcatggcgaacatcttccggggctcctacctggccggcgccgggctcctcttcagcatcatgaagaacacgaccaacacccgccggggcaccgggaacatcggcgagacgctgggcgagaagtggaagtcccgcctgaacgccctcggcaagagcgagttccagatctacaagaagtccggcatccaggaggtggaccgcaccctggccaaggaggggatcaagcggggcgagaccgaccaccacgcggtcagccgcgggtccgccaagctgcggtggttcgtggagcgcaacatggtgacccccgagggcaaggtcgtggacctcggctgcgggcggggcgggtggagctactactgcggcgggctgaagtccgtgcgcgaggtcaagggcctgacgaagggcgggcccggccacgaggagcccatcccgatgagcacctacgggtggaacctcgtgcggctgcagtccggcgtggacgtcttcttcatcccgcccgagaagtgcgacaccctgctctgcgacatcggggagagctcccccaacccgaccgtggaggccggccgcacgctgcgggtgctgaacctcgtcgagaactggctgaacaacaacacccagttctgcatcaaggtgctgaacccctacatgcccagcgtgatcgagaagatggaggccctgcagcgcaagtacggcggggcgctcgtccggaacccgctgagccgcaactccacccacgagatgtactgggtgagcaacgcctccggcaacatcgtgagctccgtcaacatgatcagccggatgctgatcaaccgcttcaccatgcggcacaagaaggccacctacgagcccgacgtggacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccgtgggacgtgctgcccaccgtcacccagatggcgatgacggacaccacccccttcgggcagcagcgggtgttcaaggagaaggtggacacccgcacgcaggagcccaaggagggcaccaagaagctgatgaagatcaccgccgagtggctctggaaggagctgggcaagaagaagaccccgcgcatgtgcacgcgggaggagttcacccgcaaggtccggagcaacgccgccctgggggccatcttcaccgacgagaacaagtggaagtccgcgcgcgaggccgtggaggacagccggttctgggagctcgtcgacaaggagcgcaacctgcacctggagggcaagtgcgagacctgcgtgtacaacatgatggggaagcgggagaagaagctcggcgagttcgggaaggccaagggctcccgcgccatctggtacatgtggctgggcgcccggttcctggagttcgaggcgctcgggttcctgaacgaggaccactggttcagccgcgagaactccctgagcggcgtggagggggagggcctccacaagctggggtacatcctgcgggacgtcagcaagaaggagggcggcgccatgtacgccgacgacacggccgggtgggacacccgcatcaccctcgaggacctgaagaacgaggagatggtgaccaaccacatggagggcgagcacaagaagctggcggaggccatcttcaagctcacgtaccagaacaaggtggtccgggtgcagcgccccacgccccgggggaccgtgatggacatcatctcccgccgggaccagcgcggcagcgggcaggtcggcacctacggcctgaacacgttcaccaacatggaggcccagctgatccggcagatggagggggagggcgtgttcaagaacatccagcacctcaccgtgaccgaggaggtcgccgtgcagaactggctggcccgcgtggggcgggagcgcctgtcccgcatggcgatcagcggcgacgactgcgtcgtgaagcccctcgacgaccggttcgccaacgccctgacggccctgaacgacatgggcaagatccgcaaggacatccagcagtgggagccgtccaaggggtggaacgactggacccaggtgcccttctgcagccaccacttccacgagctcatcatgaaggacggccgggtcctggtggtgccctgccgcaaccaggacgagctgatcgggcgggcccgcatctcccagggcgcggggtggagcctccgggagaccgcctgcctgggcaagtcctacgcccagatgtggagcctgatgtacttccaccgccgggacctccgcctggccgccaacgcgatctgctccgccgtccccagccactgggtgccgacctcccggacgacctggagcatccacgccaagcacgagtggatgaccaccgaggacatgctgaccgtgtggaaccgcgtctggatccgggagaacccctggatggaggacaagacgcccgtggagtcctgggaggagatcccctacctcggcaagcgcgaggaccagtggtgcgggagcctgatcggcctgacctcccgggccacctgggccaagaacatccaggcggccatcaaccaggtgcgcagcctcatcgggaacgaggagtacaccgactacatgccgagcatgaagcggttccgccgggaggaggaggaggccggcgtcctgtggtga

SEQ ID NO: 9649 - RNA, 9876 nt, synthetic construct
  misc_feature 1..9876: note = derived and/or modified CDS sequence (opt1) from DENV-2__FM210239__SS-prME
  source 1..9876: mol_type = other RNA
accgccggcgtgatcatcatgctgatccccaccgccatggcgttccacctcaccacccggaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgcgctgctggccgccttcaaggtgcgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggggcgaacttcaaggccgagcgcgtcatcgacccccggcgctgcatgaagcccgtgatcctgaccgacggcgaggagcgggtgatcctggccgggccgatgcccgtcacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgggagaaggtggacgccatcgacggggagtaccgcctccggggcgaggcccgccggaccttcgtggacctgatgcgccgcggggacctgccggtctggctcgcctaccgcgtggcggccgagggcatcaactacgccgaccggcgctggtgcttcgacggggtgaagaacaaccagatcctggaggagaacgtcgaggtggagatctggaccaaggagggcgagcggaagaagctgaagccccgctggctcgacgcccggatctactccgaccccctggcgctgaaggagttcaaggagttcgccgccggccgcaagagcctcacgctgaacctgatcaccgagatggggcggctccccaccttcatgacccagaaggcccgcgacgccctggacaacctggcggtgctccacacggccgaggccggcgggcgggcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggtacgcccagatccagccccactggatcgccgccagcatcatcctcgagttcttcctgatcgtcctgctcatccccgagcccgagaagcagcgcaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcggcccgcgagcgcctggaccctgtacgccgtggccaccaccttcgtcacgcccatgctccgccactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgggaggcgcagaagcgcgccgccgccgggatcatgaagaacccgaccgtggacggcgtgaccgtcatcgacctggaccccatcccctacgaccccaagttcgagaagcagctgggccaggtgatgctcctgatcctgtgcgtgacgcaggtcctcatgatgcgcaccacctgggccctgtgcgaggcgctgaccctcgccacgggcccgatctccaccctgtgggaggggaaccccggccggttctggaacaccaccatcgccgtgagcatggccaacatcttccgcggctcctacctggcgggggccggcctcctgttcagcatcatgaagaacacgaccaacacccggcgcgggaccggcaacatcggcgagacgctgggggagaagtggaagtcccggctcaacgccctgggcaagagcgagttccagatctacaagaagtccgggatccaggaggtggaccgcaccctggccaaggagggcatcaagcgcggggagaccgaccaccacgccgtcagccgcggctccgcgaagctccggtggttcgtggagcgcaacatggtgacccccgagggcaaggtcgtggacctggggtgcggccgcggcgggtggagctactactgcggcgggctgaaggacgtgcgcgaggtcaaggggctcacgaagggcggccccgggcacgaggagccgatccccatgtccacctacggctggaacctggtgcggctgcagagcggggtggacgtcttcttcacgccgcccgagaagtgcgacaccctcctgtgcgacatcggcgagtccagcccgaaccccacgatcgaggccggccgcaccctgcgggtgctcagcctggtggagaactggctgaacaacgacacccagttctgcatcaaggtcctcaacccctacatgccgtccgtgatcgagaagatggagaccctgcagcgcaagtacgggggcgccctggtgcggaaccccctgagccgcaactccacccacgagatgtactgggtcagcaacgccacggggaacatcgtgtccagcgtgaacatgatctcccggatgctcatcaaccgcttcaccatgaagcacaagaaggccacctacgagcccgacgtcgacctgggcagcgggacccgcaacatcggcatcgagtccgagatccccaacctggacatcatcggcaagcggatcgagaagatcaagcaggagcacgagacgagctggcactacgaccaggaccacccgtacaagacctgggcgtaccacgggtcctacgagaccaagcagaccggcagcgcctccagcatggtgaacggggtggtccgcctcctgacgaagccctgggacgtggtgcccatggtcacccagatggccatgaccgacaccacgcccttcggccagcagcgggtgttcaaggagaaggtggacacccgcacccaggagccgaaggagggcaccaagaagctgatgaagatcacggccgagtggctctggaaggagctggggaagaagaagacgccccggatgtgcacccgcgaggagttcacccggaaggtccgctccaacgccgcgctgggcgccatcttcacggacgagaacaagtggaagtccgcccgggaggccgtggaggactcccgcttctgggagctcgtggacaaggagcggaacctgcacctggaggggaagtgcgagacctgcgtctacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggagaacagcctgagcggggtggagggcgaggggctccacaagctgggctacatcctgcgcgacgtctccaagaaggagggcggggccatgtacgcggacgacaccgccggctgggacacccggatcacgctcgaggacctgaagaacgaggagatggtgaccaaccacatggagggggagcacaagaagctggccgaggccatcttcaagctcacctaccagaacaaggtggtccgcgtgcagcggcccacgccccggggcacggtgatggacatcatcagccggcgcgaccagcgcgggtccggccaggtcggcacctacgggctgaacaccttcaccaacatggaggcccagctgatccggcagatggagggcgagggggtgttcaagagcatccagcgcctcacggtgaccgaggagatcgcggtccagaactggctggcccgggtgggccgcgagcggctgtcccgcatggccatcagcggcgacgactgcgtggtcaagccgctcgacgaccggttcgcctccgccctgaccgcgctgaacgacatggggaaggtgcgcaaggacatccagcagtgggagcccagccggggctggaacgactggacccaggtgcccttctgctcccaccacttccacgagctcatcatgaaggacgggcgcgtcctggtggtgccctgccggaaccaggacgagctgatcggccgcgcccggatcagccagggggccggctggtccctcaaggagacggcctgcctgggcaagagctacgcccagatgtggtccctgatgtacttccaccgccgggacctccgcctggcggccaacgccatctgcagcgccgtcccgtcccactgggtgcccaccagccggaccacctggtccatccacgcgaagcacgagtggatgaccacggaggacatgctgaccgtgtggaaccgcgtctggatccaggagaacccctggatggaggacaagacccccgtggagagctgggaggaggtgccgtacctcgggaagcgggaggaccagtggtgcggcagcctgatcgggctgacctcccgcgccacgtgggccaagaacatccagaccgccatcaaccaggtccgcagcctcatcggcaacgaggagtacaccgactacatgccctccatgaagcggttccgccgggaggaggaggaggccggggtgctgtggtga

SEQ ID NO: 9650 - RNA, 9876 nt, synthetic construct
  misc_feature 1..9876: note = derived and/or modified CDS sequence (opt1) from DENV-2__FM210232__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggcctgcggcaaccggggccccagcctgcgcaccacgaccgcgagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggccgggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgcgatgaccgacgacatcggcatgggcgtcacctacctcgccctgctggccgccttcaaggtgcgccccacgttcgccgcggggctcctgctgcggaagctcaccagcaaggagctgatgatggccaccatcggcatcgccctgctctcccagagcaccatcccggagacgatcctggagctgaccgacgccctcgccctggggatgatggtgctgaagatcgtccgcaacatggagaagtaccagctcgcggtgaccatcatggccatctcctgcgtgcccaacgccgtcatcctgcagaacgcctggaaggtgagctgcaccatcctggcggccgtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggcgatcatggccgtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgcgaccgacgtgaagtgggaggaccaggccgagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcgtggtacctctgggaggtgaagaagcagcgcgccggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggcggtgctgatgcaccggggcaagcgcatcgagccgtcctgggccgacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgcggtctccctggacttcagcccgggcacctccgggagccccatcgtggaccgcaagggcaaggtggtcgggctgtacggcaacggcgtggtgacccggtccggggcctacgtcagcgccatcgcccagaccgagaagtccatcgaggacaaccccgagatcgaggacgacatcttccgcaagaagcggctcacgatcatggacctgcaccccggcgccgggaagaccaagcgctacctgccggcgatcgtgcgggaggccatcaagcgcggcctgcggaccctcatcctggcccccacccgcgtggtcgccgccgagatggaggaggcgctgcgcgggctccccatccggtaccagacgcccgccatccgcgccgagcacaccggccgggagatcgtggacctgatgtgccacgccaccttcaccatgcgcctgctcagcccggtgcgggtccccaactacaacctgatcatcatggacgaggcccacttcacggaccccgcgagcatcgccgcccgcggctacatctccacccgggtggagatgggggaggccgcgggcatcttcatgaccgccacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcgtgcctgcggaagaacggcaagaaggtgatccagctctcccgcaagaccttcgacagcgagtacgtcaagacccggacgaacgactgggacttcgtggtgaccaccgacatctccgagatgggggccaacttcaaggccgagcgcgtcatcgacccccggcgctgcatgaagcccgtgatcctgaccgacggcgaggagcgggtgatcctggccgggccgatgcccgtcacgcacagctccgccgcgcagcgccggggccgcatcgggcgcaaccccaagaacgagaacgaccagtacatctacatgggcgagcccctcgagaacgacgaggactgcgcccactggaaggaggccaagatgctgctggacaacatcaacaccccggagggcatcatccccagcatgttcgagcccgagcgggagaaggtggacgccatcgacggggagtaccgcctccggggcgaggcccgcaagaccttcgtggacctgatgcggcgcggggacctgccggtctggctcgcgtaccgggtggccgccgagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcgcgcatctactccgaccccctggccctgaaggagttcaaggagttcgccgccggccgcaagagcctcacgctgaacctgatcaccgagatggggcgcctccccaccttcatgacccagaaggcccgggacgcgctggacaacctggccgtgctccacacggccgaggccggcgggcgcgcctacaaccacgcgctgtccgagctgccggagaccctcgagaccctgctgctcctgaccctgctcgccacggtcaccggcggcatcttcctgttcctgatgagcgggaagggcgtggggaagatgaccctcggcatgtgctgcatcatcaccgcctccatcctgctgtggtacgcccagatccagccccactggatcgccgcgagcatcatcctcgagttcttcctgatcgtcctgctcatccccgagcccgagaagcagcggaccccgcaggacaaccagctgacgtacgtggtgatcgccatcctgaccgtcgtggccgccaccatggccaacgagatggggttcctcgagaagaccaagaaggacctgggcctgggctccatcgcgacgcaggagcccgagagcaacatcctcgacatcgacctgcgccccgccagcgcctggaccctgtacgccgtggcgaccaccttcgtcacgcccatgctccggcactccatcgagaacagctccgtgaacgtgagcctgaccgccatcgccaaccaggccaccgtcctgatggggctcggcaaggggtggccgctgtccaagatggacatcggcgtgcccctgctcgccatcgggtgctacagccaggtgaaccccatcaccctgacggcggccctgctcctgctggtcgcccactacgccatcatcggccccggcctccaggccaaggcgacccgcgaggcccagaagcgggccgccgccgggatcatgaagaacccgaccgtggacggcgtgaccgtcatcgacctggaccccatcccctacgaccccaagttcgagaagcagctgggccaggtgatgctcctgatcctgtgcgtgacgcaggtcctcatgatgcgcaccacctgggcgctgtgcgaggccctgaccctcgccacgggcccgatctccaccctgtgggaggggaaccccggccgcttctggaacaccaccatcgccgtgagcatggcgaacatcttccggggctcctacctggccggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgcggtcagccggggctccgccaagctccgctggttcgtggagcggaacatggtgacccccgagggcaaggtcgtggacctggggtgcggccgcgggggctggagctactactgcgggggcctgaaggacgtgcgggaggtcaagggcctcacgaagggcgggcccgggcacgaggagccgatccccatgtccacctacggctggaacctggtgcgcctgcagagcggggtggacgtcttcttcacgccgcccgagaagtgcgacaccctcctgtgcgacatcggcgagtccagcccgaaccccacgatcgaggccggccggaccctgcgcgtgctcagcctggtggagaactggctgaacaacgacacccagttctgcatcaaggtcctcaacccctacatgccgtccgtgatcgagaagatggagaccctgcagcggaagtacgggggcgccctggtgcgcaaccccctgagccggaactccacccacgagatgtactgggtcagcaacgccacggggaacatcgtgtccagcgtgaacatgatctcccgcatgctcatcaaccggttcaccatgaagcacaagaaggcgacctacgagcccgacgtcgacctgggcagcgggacccgcaacatcggcatcgagtccgagatccccaacctggacatcatcggcaagcgcatcgagaagatcaagcaggagcacgagacgagctggcactacgaccaggaccacccgtacaagacctgggcctaccacgggtcctacgagaccaagcagaccggcagcgcctccagcatggtgaacggggtggtccggctcctgacgaagccctgggacgtggtgcccatggtcacccagatggccatgaccgacaccacgcccttcggccagcagcgcgtgttcaaggagaaggtggacacccggacccaggagccgaaggagggcaccaagaagctgatgaagatcacggccgagtggctctggaaggagctggggaagaagaagacgccccggatgtgcacccgggaggagttcacccgcaaggtccggtccaacgcggccctgggcgccatcttcacggacgagaacaagtggaagtccgcccgcgaggcggtggaggactcccggttctgggagctcgtggacaaggagcgcaacctgcacctggaggggaagtgcgagacctgcgtctacaacatgatgggcaagcgggagaagaagctcggggagttcggcaaggccaagggcagccgcgccatctggtacatgtggctgggggcccggttcctggagttcgaggccctcggcttcctgaacgaggaccactggttctcccgcgagaacagcctgagcggggtggagggcgaggggctccacaagctgggctacatcctgcgggacgtctccaagaaggagggcggggcgatgtacgccgacgacaccgccggctgggacacccgcatcacgctcgaggacctgaagaacgaggagatggtgaccaaccacatggagggggagcacaagaagctggccgaggccatcttcaagctcacctaccagaacaaggtggtccgggtgcagcgccccacgccccggggcacggtgatggacatcatcagccgccgggaccagcgcgggtccggccaggtcggcacctacgggctgaacaccttcaccaacatggaggcgcagctgatccgccagatggagggcgagggggtgttcaagagcatccagcacctcacggtgaccgaggagatcgccgtccagaactggctggcccgggtgggccgcgagcggctgtcccgcatggccatcagcggcgacgactgcgtggtcaagccgctcgacgaccggttcgcctccgcgctgaccgccctgaacgacatggggaaggtgcgcaaggacatccagcagtgggagcccagccggggctggaacgactggacccaggtgcccttctgctcccaccacttccacgagctcatcatgaaggacgggcgcgtcctggtggtgccctgccggaaccaggacgagctgatcggccgcgcccggatcagccagggggccggctggtccctcaaggagacggcctgcctgggcaagagctacgcgcagatgtggtccctgatgtacttccaccgccgggacctccgcctggccgccaacgccatctgcagcgcggtcccgtcccactgggtgcccaccagccggaccacctggtccatccacgccaagcacgagtggatgaccacggaggacatgctgaccgtgtggaaccgcgtctggatccaggagaacccctggatggaggacaagacccccgtggagagctgggaggaggtgccgtacctcgggaagcgggaggaccagtggtgcggcagcctgatcgggctgacctcccgcgccacgtgggccaagaacatccagaccgccatcaaccaggtccggagcctcatcggcaacgaggagtacaccgactacatgccctccatgaagcgcttccgccgggaggaggaggaggcgggggtgctgtggtga

SEQ ID NO: 9651 - RNA, 9876 nt, synthetic construct
  misc_feature 1..9876: note = derived and/or modified CDS sequence (opt1) from DENV-2__FM210233__SS-prME
  source 1..9876: mol_type = other RNA
agcgcggggatgatcatcatgctgatccccaccgtgatggccttccacctcaccacccgcaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatccgcggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatggagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagcgggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccgccggggcaccgggaacatcggcgagacgctgggcgagaagtggaagtcccgcctgaacgccctcggcaagagcgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgggtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgcgggaccgtcatggacatcatcagccggcgcgaccagcggggctccggccaggtgggcacctacggcctgaacacgttcaccaacatggaggcccagctgatccgccagatggagggggagggcgtgttcaagaacatccagcacctcaccgtcaccgaggaggtggccgtgcacaactggctggcgcgcgtcgggcgggagcgcctgagccggatggccatctccggcgacgactgcgtggtgaagcccctcgacgaccgcttcgccaacgccctgacggccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacaccgactacatgccgagcatgaagcgcttccgccgggaggaggaggaggccggcgtgctgtggtga

SEQ ID NO: 9652 - RNA, 9876 nt, synthetic construct
  misc_feature 1..9876: note = derived and/or modified CDS sequence (opt1) from DENV-2__FM210241__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagcagcgagggggcctggaagcacgcccagcggatcgagacgtggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgcggagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcgggggcgtgttcacctccatcgggaaggcgctccaccaggtgttcggcgccatctacggcgccgccttcagcggggtctcctggaccatgaagatcctgatcggcgcgatcatcacgtggatcgggatgaacagccgctccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccgcccgggctactacacccagacggccgggccctggcacctcggcaagctggagatggacttcgacttctgcgaggggaccaccgtcgtggtgaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtcaactccctggtgaccgcggggcacggccagatcgacaacttcagcctcggcgtgctggggatggccctgttcctcgaggagatgctgcggacccgcgtcggcaccaagcacgccatcctgctcgtggccgtgtccttcgtcacgctgatcaccgggaacatgagcttccgggacctgggccgcgtgatggtgatggtcggggccaccatgaccgacgacatcggcatgggcgtgacgtacctcgcgctgctggccgccttcaaggtgcgccccaccttcgccgccgggctcctgctgcggaagctcacctccaaggagctgatgatggcgaccatcggcatcgccctgctcagccagtccacgatccccgagaccatcctggagctgaccgacgccctcgccctggggatgatggtcctgaagatcgtgcgcaacatggagaagtaccagctcgccgtgaccatcatggcgatcagctgcgtcccgaacgccgtgatcctgcagaacgcctggaaggtgtcctgcacgatcctggccgcggtcagcgtgagccccctgctgctgaccagctcccagcagaaggccgactggatccccctcgccctgaccatcaagggcctgaaccccaccgccatcttcctcacgaccctgagccggacctccaagaagcgcagctggccgctgaacgaggccatcatggcggtgggcatggtctccatcctcgccagcagcctgctgaagaacgacatccccatgaccgggcccctcgtggccggcgggctgctgacggtctgctacgtgctcaccggccggtccgccgacctggagctggagcgcgccaccgacgtgaagtgggaggaccaggcggagatcagcgggtccagccccatcctctccatcaccatcagcgaggacggctccatgagcatcaagaacgaggaggaggagcagacgctgaccatcctgatccggaccggcctcctggtcatctccgggctgttcccggtgagcatccccatcaccgccgccgcctggtacctctgggaggtgaagaagcagcgcgccggcgtcctgtgggacgtgcccagcccgccgcccgtggggaaggcggagctggaggacggcgcctaccggatcaagcagaaggggatcctcggctacagccagatcggcgccggggtctacaaggagggcaccttccacacgatgtggcacgtgacccgcggggccgtgctgatgcaccggggcaagcgcatcgagccctcctgggccgacgtcaagaaggacctgatcagctacgggggcggctggaagctcgagggggagtggaaggagggcgaggaggtccaggtgctggcgctggagcccgggaagaacccccgggccgtccagaccaagcccggcctcttcaagaccaacacggggaccatcggcgccgtgtccctggacttcagccccggcacctccgggagccccatcgtggaccgcaagggcaaggtcgtggggctgtacggcaacggcgtggtcacccggtccggggcctacgtgagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcggaccctcatcctggcgccgacgcgcgtcgtggccgccgagatggaggaggccctgcgcgggctccccatccggtaccagacccccgccatccgcgcggagcacaccggccgggagatcgtggacctgatgtgccacgccaccttcacgatgcgcctgctctcccccgtccgggtgccgaactacaacctgatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagtccaacgcgcccatcatcgacgaggagcgggagatccccgagcgcagctggaactccggccacgagtgggtcaccgacttcaaggggaagaccgtgtggttcgtgccgagcatcaaggccggcaacgacatcgccgcctgcctgcggaagaacggcaagaaggtcatccagctctcccgcaagaccttcgacagcgagtacgtgaagacgcggaccaacgactgggacttcgtggtcaccaccgacatctccgagatgggggccaacttcaaggcggagcgcgtgatcgacccccggcgctgcatgaagcccgtgatcctgacggacggcgaggagcgggtcatcctggccgggcccatgccggtgacccacagctccgccgcccagcgccggggccgcatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagaccttcgtcgacctgatgcggcgcggggacctgcccgtgtggctcgcctaccgggtggccgcggagggcatcaactacgccgaccgccggtggtgcttcgacggggtcaagaacaaccagatcctggaggagaacgtggaggtggagatctggacgaaggagggcgagcgcaagaagctgaagccgcggtggctcgacgcccgcatctactccgaccccctggccctgaaggagttcaaggagttcgcggccggccggaagtccctcaccctgaacctgatcaccgagatggggcgcctccccaccttcatgacgcagaaggcccgggacgccctggacaacctggccgtcctccacaccgcggaggccggcgggcgcgcctacaaccacgccctgtccgagctgcccgagaccctcgagaccctgctgctcctgacgctgctcgccaccgtgaccggcggcatcttcctgttcctgatgagcgggaagggcgtggggaagatgaccctcggcatgtgctgcatcatcaccgcgtccatcctgctgtggtacgcccagatccagccgcactggatcgccgccagcatcatcctcgagttcttcctgatcgtcctgctcatccccgagcccgagaagcagcggacgccccaggacaaccagctgacctacgtggtcatcgccatcctgaccgtggtggcggccaccatggccaacgagatggggttcctcgagaagacgaagaaggacctgggcctgggcagcatcgccacccaggagccggagtccaacatcctcgacatcgacctgcgccccgccagcgcgtggaccctgtacgccgtcgccaccacgttcgtgacccccatgctccggcactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcacgctgaccgccgccctgctctccctgatcgcgcactacgccatcatcggccccggcctgcaggccaaggccacccgcgaggcccagaagcgggcggccgccgggatcatgaagaaccccaccgtggacggcatcacggtgatcgacctcgacccgatcccctacgaccccaagttcgagaagcagctggggcaggtcatgctgctcatcctgtgcgtgacccaggtgctgatgatgcgcaccacctgggccctctgcgaggccctgacgctggcgaccggccccatcagcaccctctgggaggggaacccgggccgcttctggaacaccacgatcgccgtctccatggccaacatcttccggggcagctacctggccggggcgggcctcctcttctccatcatgaagaacaccaccaacacccgccgggggacgggcaacatcggcgagaccctgggggagaagtggaagtcccgcctgaacgccctcggcaagtccgagttccagatctacaagaagtccgggatccaggaggtggaccggaccctggccaaggagggcatcaagcgcggggagaccgaccaccacgccgtgtcccggggcagcgccaagctgcgctggttcgtcgagcggaacatggtgacgcccgagggcaaggtggtcgacctcgggtgcggccgcgggggctggtcctactactgcgggggcctgaagaacgtgcgggaggtgaagggcctgaccaagggcggccccgggcacgaggagcccatcccgatgagcacctacggctggaacctcgtccgcctgcagagcggggtggacgtgttcttcacgccgcccgagaagtgcgacacgctgctctgcgacatcggcgagtccagccccaacccgaccatcgaggcgggccggaccctgcgcgtcctgtccctcgtggagaactggctgaacaacgacacccagttctgcatcaaggtgctgaacccctacatgcccagcgtcatcgagaagatggagaccctccagcggaagtacgggggcgccctggtgcgcaacccgctgtcccggaacagcacgcacgagatgtactgggtgtccaacgccaccgggaacatcgtcagctccgtgaacatgatcagccgcatgctgatcaaccggttcaccatgaagcacaagaaggccacctacgagcccgacgtggacctcggctccgggacgcgcaacatcggcatcgagagcgagatccccaacctggacatcatcggcaagcgcatcgagaagatcaagcaggagcacgagacctcctggcactacgaccaggaccacccctacaagacctgggcctaccacgggagctacgagaccaagcagacgggctccgcgagctccatggtcaacggggtggtgcggctgctcaccaagccgtgggacgtcgtgcccatggtgacccagatggccatgaccgacacgacccccttcggccagcagcgcgtcttcaaggagaaggtggacacccggacccaggagcccaaggagggcacgaagaagctgatgaagatcaccgccgagtggctgtggaaggagctcgggaagaagaagaccccgcgcatgtgcacccgggaggagttcacgcgcaaggtgcggagcaacgccgccctgggcgcgatcttcaccgacgagaacaagtggaagtccgcccgcgaggccgtcgaggacagccggttctgggagctggtggacaaggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgagaacagcctgtccggggtcgagggcgaggggctgcacaagctcggctacatcctgcgggacgtgagcaagaaggagggcggggccatgtacgccgacgacaccgcgggctgggacacgcgcatcaccctggaggacctcaagaacgaggagatggtgaccaaccacatggagggggagcacaagcggctggccgaggccatcttcaagctgacctaccagaacaaggtcgtgcgcgtccagcggcccacgccccgcggcaccgtgatggacatcatctcccggcgcgaccagcgcgggagcggccaggtgggcacctacgggctcaacaccttcacgaacatggaggcccagttcatccggcagatggagggcgaggggatcttcaagtccatccagcacctgaccgtcaccgaggagatcgccgtgcagaactggctggcgcgcgtgggccgggagcgcctcagccggatggccatctccggcgacgactgcgtcgtgaagcccctggacgaccgcttcgccagcgccctgaccgccctcaacgacatggggaaggtgcggaaggacatccagcagtgggagccgtccaagggctggaacgactggacgcaggtccccttctgcagccaccacttccacgagctgatcatgaaggacgggcgcgtgctggtggtcccctgccggaaccaggacgagctcatcggccgcgcgcggatctcccagggggccggctggagcctgaaggagaccgcctgcctgggcaagtcctacgcccagatgtggagcctcatgtacttccaccgccgggacctgcgcctggccgcgaacgccatctgctccgccgtgcccagccactgggtgccgaccagccggaccacctggtccatccacgccaagcacgagtggatgacgaccgaggacatgctcaccgtctggaaccgcgtgtggatccaggagaacccctggatggaggacaagacccccgtggagagctgggaggaggtcccctacctggggaagcgggaggaccagtggtgcggctccctgatcgggctcacgagccgcgcgacctgggccaagaacatccagaccgccatcaaccaggtgcggtccctgatcggcaacgaggagtacaccgactacatgccgagcatgaagcgcttccgccgggaggaggaggaggccggggtgctgtggtga

SEQ ID NO: 9653 - RNA, 9876 nt, synthetic construct
  misc_feature 1..9876: note = derived and/or modified CDS sequence (opt1) from DENV-2__FM210242__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtggtgctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatcaaggcggagcacacggggcgggagatcgtcgacctcatgtgccacgccaccttcaccatgcgcctgctgagccccgtgcgcgtgccgaactacaacctcatcatcatggacgaggcccacttcaccgaccccgcctccatcgccgcgcggggctacatcagcacgcgcgtcgagatgggcgaggccgccgggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtgtggttcgtcccgagcatcaaggcggggaacgacatcgccgcctgcctgcgcaagaacggcaagaaggtgatccagctgtcccggaagaccttcgacagcgagtacgtgaagacccgcaccaacgactgggacttcgtcgtgacgaccgacatctccgagatgggcgccaacttcaaggcggagcgggtgatcgacccccgccggtgcatgaagcccgtcatcctcaccgacggggaggagcgcgtgatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtcgacgccatcgacggcgagtaccgcctgcgcggggaggcccgcaagaccttcgtggacctcatgcgccggggcgacctgcccgtgtggctggcctacaaggtcgccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtgctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtcacgcccatgctgcgccacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgggaggcccagaagcgcgccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcggaccacctgggccctctgcgaggccctgaccctggccacggggcccatctccaccctctgggagggcaacccggggcgcttctggaacaccaccatcgcggtcagcatggccaacatcttccggggctcctacctggccggcgccgggctcctcttcagcatcatgaagaacacgaccaacacccgccggggcaccgggaacatcggcgagacgctgggcgagaagtggaagtcccgcctgaacgccctcggcaagagcgagttccagatctacaagaagtccggcatccaggaggtggaccgcaccctggcgaaggaggggatcaagcggggcgagaccgaccaccacgccgtgagccgcgggtccgccaagctgcggtggttcgtcgagcgcaacatggtgacccccgagggcaaggtggtcgacctcggctgcgggcggggcgggtggagctactactgcggcgggctgaagtccgtgcgcgaggtgaagggcctgacgaagggcgggcccggccacgaggagcccatcccgatgagcacctacgggtggaacctcgtccggctgcagtccggcgtggacgtgttcttcatcccgcccgagaagtgcgacaccctgctctgcgacatcggggagagctcccccaacccgaccgtcgaggccggccgcacgctgcgggtgctgaacctcgtggagaactggctgaacaacaacacccagttctgcatcaaggtcctgaacccctacatgcccagcgtgatcgagaagatggaggcgctgcagcgcaagtacggcggggccctcgtgcggaacccgctgagccgcaactccacccacgagatgtactgggtcagcaacgcctccggcaacatcgtgagctccgtgaacatgatcagccggatgctgatcaaccgcttcaccatgcggcacaagaaggccacctacgagcccgacgtcgacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgcgagctccatggtgaacggcgtggtccgcctgctcaccaagccgtgggacgtgctgcccaccgtgacccagatggccatgacggacaccacccccttcgggcagcagcgggtcttcaaggagaaggtggacacccgcacgcaggagcccaaggagggcaccaagaagctgatgaagatcaccgccgagtggctctggaaggagctgggcaagaagaagaccccgcgcatgtgcacgcgggaggagttcacccgcaaggtgcggagcaacgccgccctgggggcgatcttcaccgacgagaacaagtggaagtccgcccgcgaggccgtcgaggacagccggttctgggagctcgtggacaaggagcgcaacctgcacctggagggcaagtgcgagacctgcgtctacaacatgatggggaagcgggagaagaagctcggcgagttcgggaaggccaagggctcccgcgccatctggtacatgtggctgggcgcgcggttcctggagttcgaggccctcgggttcctgaacgaggaccactggttcagccgcgagaactccctgagcggcgtggagggggagggcctccacaagctggggtacatcctgcgggacgtgagcaagaaggagggcggcgccatgtacgccgacgacacggcggggtgggacacccgcatcaccctcgaggacctgaagaacgaggagatggtcaccaaccacatggagggcgagcacaagaagctggccgaggccatcttcaagctcacgtaccagaacaaggtggtgcgggtccagcgccccacgccccgggggaccgtgatggacatcatctcccgccgggaccagcgcggcagcggccaggtggggacctacggcctgaacacgttcaccaacatggaggcccagctgatccggcagatggagggggagggcgtcttcaagaacatccagcacctcaccgtgaccgaggaggtggccgtccagaactggctggcgcgcgtggggcgggagcgcctgtcccgcatggccatcagcggcgacgactgcgtggtcaagcccctcgacgaccggttcgccaacgccctgacggccctgaacgacatgggcaagatccgcaaggacatccagcagtgggagccgtccaaggggtggaacgactggacccaggtgcccttctgcagccaccacttccacgagctcatcatgaaggacggccgggtgctggtcgtgccctgccgcaaccaggacgagctgatcgggcgggcgcgcatctcccagggcgccgggtggagcctccgggagaccgcctgcctgggcaagtcctacgcccagatgtggagcctgatgtacttccaccgccgggacctccgcctggccgcgaacgccatctgctccgccgtgcccagccactgggtcccgacctcccggacgacctggagcatccacgccaagcacgagtggatgaccaccgaggacatgctgaccgtgtggaaccgcgtgtggatccgggagaacccctggatggaggacaagacgcccgtcgagtcctgggaggagatcccctacctcggcaagcgcgaggaccagtggtgcgggagcctgatcggcctgacctcccgggccacctgggcgaagaacatccaggccgccatcaaccaggtgcgcagcctcatcgggaacgaggagtacaccgactacatgccgagcatgaagcggttccgccgggaggaggaggaggccggcgtgctgtggtga

SEQ ID NO: 9654 - RNA, 9876 nt, synthetic construct
  misc_feature 1..9876: note = derived and/or modified CDS sequence (opt1) from DENV-2__FM210243__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccaccccggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtccagcatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccctggctgccgggggccgacacccagggcagcaactggatccagaaggagaccctggtgacgttcaagaacccccacgccaagaagcaggacgtggtcgtgctcgggtcccaggagggcgccatgcacaccgccctgaccggggcgaccgagatccagatgagcagcggcaacctcctgttcacgggccacctgaagtgccgcctgcggatggacaagctccagctgaaggggatgtcctacagcatgtgcaccggcaagttcaagatcgtcaaggagatcgccgagacccagcacgggaccatcgtgatccgcgtgcagtacgagggcgacggctccccctgcaagatccccttcgagatcatggacctggagaagcggcacgtcctcgggcgcctgatcacggtgaacccgatcgtgaccgagaaggacagccccgtcaacatcgaggccgagccgcccttcggcgactcctacatcatcatcggggtggagccgggccagctgaagctcaactggttcaagaaggggagctccatcggccagatgttcgagaccaccatgcgcggcgccaagcggatggccatcctgggggacacggcgtgggacttcggcagcctcggcggggtgttcacctccatcgggaaggccctccaccaggtcttcggggccatctacggcgccgcgttcagcggggtgtcctggaccatgaagatcctgatcggcgtgatcatcacctggatcgggatgaacagccgctccacgagcctgtccgtcagcctggtgctcgtgggcatcatcaccctgtacctgggggccatggtccaggccgactccggctgcgtggtgagctggaagaacaaggagctcaagtgcggctccgggatcttcatcaccgacaacgtccacacctggacggagcagtacaagttccagcccgagagccccagcaagctggcctccgccatccagaaggcgcacgaggagggcatctgcgggatccggagcgtgacccgcctggagaacctcatgtggaagcagatcacccccgagctgaaccacatcctgtccgagaacgaggtgaagctcaccatcatgacgggcgacatcaaggggatcatgcaggccggcaagcggagcctgcgcccgcagcccaccgagctgaagtactcctggaagacctggggcaaggccaagatgctcagcaccgagtcccacaaccagacgttcctgatcgacgggcccgagaccgccgagtgcccgaacaccaaccgggcctggaacagcctggaggtcgaggactacggcttcggggtgttcaccacgaacatctggctcaagctgcgcgagaagcaggacgtgttctgcgactccaagctgatgagcgcggccatcaaggacaaccgggccgtccacgccgacatgggctactggatcgagtccgccctcaacgacacctggaagatggagaaggcgagcttcatcgaggtgaagtcctgccactggcccaagagccacaccctgtggtccaacggcgtgctggagagcgagatgatcatccccaagtccttcgccgggcccgtcagccagcacaactaccgcccgggctactacacccagaccgccgggccctggcacctcggcaagctggagatggacttcgacttctgcgaggggacgaccgtggtggtcaccgaggactgcggcaaccggggccccagcctgcgcaccacgaccgcctccgggaagctcatcaccgagtggtgctgccggagctgcaccctgcccccgctgcgctaccggggcgaggacgggtgctggtacggcatggagatccgccccctcaaggagaaggaggagaacctggtgaactccctggtgacggcggggcacggccagatcgacaacttcagcctcggcgtcctggggatggccctgttcctcgaggagatgctgcggacccgcgtgggcaccaagcacgccatcctgctcgtgaccgtctccttcgtgacgctgatcaccgggaacatgagcttccgggacctgggccgcgtgatggtcatggtgggggccgccatgaccgacgacatcggcatgggcgtgacctacctcgcgctgctggccgccttcaaggtccgccccacgttcgccgccgggctcctgctgcggaagctcacctccaaggagctgatgatggcgaccatcggcatcgccctgctcagccagtccaccatccccgagacgatcctggagctgaccgacgccctcgccctggggatgatggtgctgaagatcgtgcgcaacatggagaagtaccagctcgccgtcaccatcatggcgatcagctgcgtgccgaacgccgtgatcctgcagaacgcctggaaggtctcctgcaccatcctggccgcggtgagcgtgttccccctcctgctgacgtccagccagcagaaggccgactggatccccctcgccctgaccatcaagggcctgaaccccaccgccatcttcctcaccacgctgtcccggaccagcaagaagcgctcctggccgctgaacgaggccatcatggcggtcggcatggtgagcatcctcgcctccagcctgctgaagaacgacatccccatgaccgggcccctcgtcgccggcgggctgctgaccgtgtgctacgtgctcacgggccggagcgccgacctggagctggagcgcgccaccgacgtcaagtgggaggaccaggcggagatctccgggagctcccccatcctcagcatcaccatcgccgaggacggctccatgagcatcaagaacgaggaggaggagcagaccctgacgatcctgatccggaccggcctcctggtgatctccgggctgttcccggtgagcatccccatcaccgccgccgcctggtacctctgggaggtcaagaagcagcgcgcgggcgtgctgtgggacgtgcccagcccgccgcccgtcgggaaggccgagctggaggacggcgcctaccggatcaagcagaaggggatcctcggctacagccagatcggcgccggggtgtacaaggagggcaccttccacaccatgtggcacgtgacgcgcggggccgtcctgatgcaccggggcaagcgcatcgagccctcctgggcggacgtgaagaaggacctgatcagctacgggggcggctggaagctcgagggggagtggaaggagggcgaggaggtgcaggtcctggccctggagcccgggaagaacccccgggccgtgcagaccaagcccggcctcttcaagaccaacaccgggacgatcggcgccgtgtccctggacttcagccccggcacctccgggagccccatcgtcgaccgcaagggcaaggtggtggggctgtacggcaacggcgtcgtgacccggtccggggcgtacgtgagcgccatcgcccagaccgagaagtccatcgaggacaaccccgagatcgaggacgacatcttccgcaagaagcggctcacgatcatggacctgcaccccggcgccgggaagaccaagcgctacctgcccgccatcgtccgggaggcgatcaagcgcggcctgcggaccctcatcctggccccgacccgcgtggtggccgccgagatggaggaggccctgcgcgggctccccatccggtaccagacgcccgcgatccgcgccgagcacaccggccgggagatcgtcgacctgatgtgccacgccaccttcaccatgcgcctgctcagccccgtgcgggtgccgaactacaacctgatcatcatggacgaggcccacttcacggaccccgccagcatcgcggcccgcggctacatctccacccgggtcgagatgggggaggccgccggcatcttcatgaccgcgacgccgcccgggagccgcgacccgttcccccagtccaacgcccccatcatggacgaggagcgggagatccccgagcgcagctggaactccggccacgagtgggtgacggacttcaaggggaagaccgtgtggttcgtcccgagcatcaaggccggcaacgacatcgccgcctgcctgcggaagaacggcaagaaggtgatccagctctcccgcaagaccttcgacagcgagtacgtgaagacccggacgaacgactgggacttcgtcgtgaccaccgacatctccgagatgggggcgaacttcaaggccgagcgcgtgatcgacccccggcgctgcatgaagcccgtcatcctgaccgacggcgaggagcgggtgatcctggccgggcccatgccggtgacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgggagaaggtcgacgccatcgacggggagtaccgcctccggggcgaggcccgcaagaccttcgtggacctgatgcggcgcggggacctgcccgtgtggctcgcctaccgggtcgcggccgagggcatcaactacgccgaccgccggtggtgcttcgacggggtgaagaacaaccagatcctggaggagaacgtggaggtcgagatctggaccaaggagggcgagcgcaagaagctgaagccgcggtggctcgacgcccgcatctactccgaccccctggcgctgaaggagttcaaggagttcgccgccggccggaagtccctcacgctgaacctgatcaccgagatggggcgcctccccaccttcatgacccagaaggcccgggacgccctggacaacctggcggtgctccacacggccgaggccggcgggcgcgcctacaaccacgccctgtccgagctgcccgagaccctcgagaccctgctgctcctgaccctgctcgcgacggtgaccggcggcatcttcctgttcctgatgagcgggaagggcgtcgggaagatgaccctcggcatgtgctgcatcatcaccgcctccatcctgctgtggtacgcccagatccagccgcactggatcgccgccagcatcatcctcgagttcttcctgatcgtgctgctcatccccgagcccgagaagcagcggacgccccaggacaaccagctgacgtacgtcgtgatcgcgatcctgaccgtggtcgccgccaccatggccaacgagatggggttcctcgagaagaccaagaaggacctgggcctgggctccatcgccacgcaggagccggagagcaacatcctcgacatcgacctgcgccccgcgagcgcctggaccctgtacgccgtggccaccaccttcgtgacgcccatgctccggcactccatcgagaacagctccgtcaacgtgagcctgaccgcgatcgccaaccaggccaccgtgctgatggggctcggcaaggggtggcccctgtccaagatggacatcggcgtcccgctgctcgccatcgggtgctacagccaggtgaaccccatcaccctgacggccgcgctgctcctgctggtggcccactacgccatcatcggccccggcctccaggccaaggccacccgcgaggcgcagaagcgggccgccgccgggatcatgaagaaccccaccgtcgacggcatcaccgtgatcgacctggacccgatcccctacgaccccaagttcgagaagcagctgggccaggtgatgctcctgatcctgtgcgtcacccaggtgctcatgatgcgcaccacctgggccctgtgcgaggcgctgaccctcgccacgggccccatctccaccctgtgggaggggaacccgggccgcttctggaacaccaccatcgccgtgagcatggccaacatcttccggggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtcgaccggaccctggccaaggagggcatcaagcgcggggagaccgaccaccacgccgtgagccggggctccgcgaagctccgctggttcgtggagcggaacatggtcacccccgagggcaaggtggtggacctggggtgcggccgcgggggctggagctactactgcgggggcctgaagaacgtccgggaggtgaagggcctcacgaagggcggccccgggcacgaggagcccatcccgatgtccacctacggctggaacctggtgcgcctgcagagcggggtcgacgtgttcttcacgccgcccgagaagtgcgacaccctcctgtgcgacatcggcgagtccagccccaacccgacgatcgaggccggccggaccctgcgcgtgctcagcctggtcgagaactggctgaacaacgacacccagttctgcatcaaggtgctcaacccctacatgccctccgtgatcgagaagatggagaccctgcagcggaagtacgggggcgccctggtccgcaacccgctgagccggaactccacccacgagatgtactgggtgagcaacgccacggggaacatcgtgtccagcgtcaacatgatctcccgcatgctcatcaaccggttcaccatgaagcacaagaaggccacctacgagcccgacgtggacctgggcagcgggacccgcaacatcggcatcgagtccgagatccccaacctggacatcatcggcaagcgcatcgagaagatcaagcaggagcacgagacgagctggcactacgaccaggaccacccctacaagacctgggcgtaccacgggtcctacgagaccaagcagaccggcagcgcctccagcatggtgaacggggtcgtgcggctcctgacgaagccgtgggacgtggtccccatggtgacccagatggccatgaccgacaccacgcccttcggccagcagcgcgtgttcaaggagaaggtcgacacccggacccaggagcccaaggagggcaccaagaagctgatgaagatcacggccgagtggctctggaaggagctggggaagaagaagaccccgcgcatgtgcacccgggaggagttcacccgcaaggtgcggtccaacgccgcgctgggcgccatcttcacggacgagaacaagtggaagtccgcccgcgaggccgtggaggactcccggttctgggagctcgtcgacaaggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtggagggcgaggggctccacaagctgggctacatcctgcgggacgtctccaagaaggagggcggggccatgtacgcggacgacaccgccggctgggacacccgcatcacgctcgaggacctgaagaacgaggagatggtgaccaaccacatggagggggagcacaagaagctggccgaggccatcttcaagctcacctaccagaacaaggtcgtgcgggtgcagcgccccacgccccggggcacggtcatggacatcatcagccgccgggaccagcgcgggtccggccaggtgggcacctacgggctgaacaccttcaccaacatggaggcccagctgatccgccagatggagggcgaggggatcttcaagagcatccagcacctcacggtgaccgaggagatcgcggtccagaactggctggcccgggtgggccgcgagcggctgtcccgcatggccatcagcggcgacgactgcgtggtcaagcccctcgacgaccggttcgcctccgccctgaccgcgctgaacgacatggggaaggtgcgcaaggacatccagcagtgggagccgagccggggctggaacgactggacccaggtgcccttctgctcccaccacttccacgagctcatcatgaaggacgggcgcgtcctggtggtgccctgccggaaccaggacgagctgatcggccgcgcccggatcagccagggggccggctggtccctcaaggagacggcctgcctgggcaagagctacgcccagatgtggtccctgatgtacttccaccgccgggacctccgcctggcggccaacgccatctgcagcgccgtcccctcccactgggtgccgaccagccggaccacctggtccatccacgcgaagcacgagtggatgaccacggaggacatgctgaccgtgtggaaccgcgtctggatccaggagaacccctggatggaggacaagacccccgtggagagctgggaggaggtgccctacctcgggaagcgggaggaccagtggtgcggcagcctgatcgggctgacctcccgcgccacgtgggccaagaacatccagaccgccatcaaccaggtccggagcctcatcggcaacgaggagtacaccgactacatgccgtccatgaagcgcttccgccgggaggaggaggaggccggggtgctgtggtga

SEQ ID NO: 9655 - RNA, 9876 nt, synthetic construct
  misc_feature 1..9876: note = derived and/or modified CDS sequence (opt1) from DENV-2__FM210244__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcgccgtgagcttcgtgaccctgatcacggggaacatgtccttccgggacctgggccgcgtcatggtgatggtgggggccgcgatgaccgacgacatcggcatcggcgtcacctacctcgccctgctggccgccttcaaggtgcgccccaccttcgccgcggggctcctgctgcggaagctcacgagcaaggagctgatgatggccaccatcggcatcgccctgctctcccagagcaccatcccggagaccatcctggagctgacggacgccctcgccctggggatgatggtgctgaagatcgtccgcaacatggagaagtaccagctcgcggtgaccatcatggccatctcctgcgtgcccaacgccgtcatcctgcagaacgcctggaaggtgagctgcaccatcctggcgaccgtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagcaaggaccccttcccccagtccaacgcccccatcatggacgaggagcgcgagatccccgagcggagctggaactccggccacgagtgggtgacggacttcaaggggaagaccgtctggttcgtgcccagcatcaaggccggcaacgacatcgccgcctgcctgcgcaagaacggcaagaaggtgatccagctctcccggaagaccttcgacagcgagtacgtcaagacccgcacgaacgactgggacttcgtggtgaccaccgacatctccgagatgggggcgaacttcaaggccgagcgggtcatcgacccccgccggtgcatgaagcccgtgatcctgaccgacggcgaggagcgcgtgatcctggccgggccgatgcccgtcacgcacagctccgccgcccagcggcgcggccggatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgcgagaaggtggacgccatcgacggggagtaccggctccgcggcgaggcccggaagaccttcgtggacctgatgcgccgcggggacctgccggtctggctcgcctaccgcgtggcggccgagggcatcaactacgccgaccggcgctggtgcttcgacggggtgaagaacaaccagatcctggaggagaacgtcgaggtggagatctggaccaaggagggcgagcggaagaagctgaagccccgctggctcgacgcccggatctactccgaccccctggcgctgaaggagttcaaggagttcgccgccggccgcaagagcctcacgctgaacctgatcaccgagatggggcggctccccaccttcatgacccagaaggcccgcgacgccctggacaacctggcggtgctccacacggccgaggccggcgggaaggcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggcacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgcgaggcgcagaagcgggccgccgccgggatcatgaagaacccgaccgtggacggcatcaccgtgatcgacctggaccccatcccctacgaccccaagttcgagaagcagctggggcaggtcatgctcctgatcctgtgcgtgacccaggtgctcatgatgcgcaccacctgggccctgtgcgaggcgctgaccctcgccacgggcccgatctccaccctgtgggaggggaaccccggccggttctggaacaccaccatcgccgtcagcatggccaacatcttccgcggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtgagccggggctccgcgaagctccgctggttcgtcgagcggaacatggtgacccccgagggcaaggtggtcgacctggggtgcggccgcgggggctggagctactactgcgggggcctgaagaacgtgcgggaggtgaagggcctcacgaagggcggccccgggcacgaggagccgatccccatgtccacctacggctggaacctggtccgcctgcagagcggggtggacgtgttcttcacgccgcccgagaagtgcgacaccctcctgtgcgacatcggcgagtccagcccgaaccccacgatcgaggccggccggaccctgcgcgtcctcagcctggtggagaactggctgaacaacgacacccagttctgcatcaaggtgctcaacccctacatgccgtccgtcatcgagaagatggagaccctgcagcggaagtacgggggcgccctggtgcgcaaccccctgagccggaactccacccacgagatgtactgggtgagcaacgccacggggaacatcgtctccagcgtgaacatgatctcccgcatgctcatcaaccggttcaccatgaagcacaagaaggccacctacgagcccgacgtggacctgggcagcgggacccgcaacatcggcatcgagtccgagatgcccaacctggacatcatcggcaagcggatcgagaagatcaagcaggagcacgagacgagctggcactacgaccaggaccacccgtacaagacctgggcgtaccacgggtcctacgagaccaagcagaccggcagcgcctccagcatggtcaacggggtggtgcgcctcctgacgaagccctgggacgtcgtgcccatggtgacccagatggccatgaccgacaccacgcccttcggccagcagcgcgtcttcaaggagaaggtggacacccggacccaggagccgaaggagggcaccaagaagctgatgaagatcacggccgagtggctctggaaggagctggggaagaagaagacgccccggatgtgcacccgggaggagttcacccgcaaggtgcggtccaacgccgcgctgggcgccatcttcacggacgagaacaagtggaagtccgcccgcgaggccgtcgaggactcccggttctgggagctcgtggacaaggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtcgagggcgaggggctccacaagctgggctacatcctgcgggacgtgtccaagaaggagggcggggccatgtacgcggacgacaccgccggctgggacacccgcatcacgctcgaggacctgaagaacgaggagatggtcaccaaccacatggagggggagcacaagaagctggccgaggccatcttcaagctcacctaccagaacaaggtggtgcgggtccagcgccccacgccccggggcacggtgatggacatcatcagccgccgggaccagcgcgggtccggccaggtgggcacctacgggctgaacaccttcaccaacatggaggcccagctgatccggcagatggagggcgaggggatcttcaagagcatccagcacctcacggtcaccgaggagatcgcggtgcagaactggctggcccgcgtgggccgcgagcggctgtcccgcatggccatcagcggcgacgactgcgtcgtgaagccgctcgacgaccggttcgcctccgccctgaccgcgctgaacgacatggggaaggtgcgcaaggacatccagcagtgggagcccagccggggctggaacgactggacccaggtccccttctgctcccaccacttccacgagctcatcatgaaggacgggcgcgtgctggtggtcccctgccggaaccaggacgagctgatcggccgcgcccggatcagccagggggccggctggtccctcaaggagacggcctgcctgggcaagagctacgcccagatgtggtccctgatgtacttccaccgccgggacctccgcctggcggccaacgccatctgcagcgccgtgccgtcccactgggtgcccaccagccggaccacctggtccatccacgcgaagcacgagtggatgaccacggaggacatgctgaccgtctggaaccgcgtgtggatccaggagaacccctggatggaggacaagacccccgtggagagctgggaggaggtcccgtacctcgggaagcgggaggaccagtggtgcggcagcctgatcgggctgacctcccgcgccacgtgggccaagaacatccagaccgccatcaaccaggtgcggagcctcatcggcaacgaggagtacaccgactacatgccctccatgaagcgcttccggcgcgaggaggaggaggccggggtgctgtggtga

SEQ ID NO: 9656 - RNA, 9876 nt, synthetic construct
  misc_feature 1..9876: note = derived and/or modified CDS sequence (opt1) from DENV-2__FM210234__SS-prME
  source 1..9876: mol_type = other RNA
accgccggggtgatcatcatgctgatccccaccgccatggcgttccacctcaccacccggaacggggagccccacatgatcgtcgggcggcaggagaagggcaagagcctgctgttcaagaccgaggacggggtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatggggctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcggcctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctcttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccggcaaggactcccccgtcaacatcgaggccgagcccccgttcggggacagctacatcatcatcggcgtggagcccgggcagctgaagctcaactggttcaagaagggctccagcatcggccagatgttcgagaccaccatgcgcggggccaagcggatggccatcctgggcgacacggcgtgggacttcgggtccctgggcggggtgttcaccagcatcggcaaggccctccaccaggtcttcggcgccatctacggggccgcgttctccggcgtgagctggaccatgaagatcctgatcggggtgatcatcacctggatcggcatgaactcccgcagcacgtccctgagcgtctccctggtgctcgtgggggtcatcaccctgtacctgggcgccatggtgcaggccgacagcggctgcgtggtctcctggaagaacaaggagctcaagtgcgggagcggcatcttcatcaccgacaacgtgcacacctggacggagcagtacaagttccagcccgagtcccccagcaagctggccagcgccatccagaaggcgcacgaggaggggatctgcggcatccggtccgtgacccgcctggagaacctcatgtggaagcagatcaccccggagctgaaccacatcctgagcgagaacgaggtcaagctcaccatcatgacgggggacatcaagggcatcatgcaggccggcaagcggtccctgcgcccccagcccaccgagctgaagtacagctggaagacctgggggaaggccaagatgctctccaccgagagccacaaccagacgttcctgatcgacggcccggagaccgccgagtgccccaacaccaaccgggcctggaactccctggaggtggaggactacgggttcggcgtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggggtgctggagtccgagatgatcatccccaagagcttcgccggcccggtgtcccagcacaactaccgccccgggtactacacccagaccgccggcccctggcacctcgggaagctggagatggacttcgacttctgcgagggcacgaccgtggtcgtgaccgaggactgcggcaaccgggggcccagcctgcgcaccacgaccgccagcggcaagctcatcaccgagtggtgctgccggtcctgcaccctgccgcccctgcgctaccgcggggaggacggctgctggtacgggatggagatccgccccctcaaggagaaggaggagaacctggtgaacagcctggtcacggcgggccacggccagatcgacaacttctccctcggggtgctgggcatcgccctgttcctcgaggagatgctgcggacccgcgtggggaccaagcacgccatcctgctcgtcgccgtgagcttcgtgaccctgatcacgggcaacatgtccttccgggacctggggcgcgtcatggtgatggtgggcgccgcgatgaccgacgacatcggcatgggggtcacctacctcgccctgctggccgccttcaaggtgcgccccaccttcgccgcgggcctcctgctgcggaagctcacgagcaaggagctgatgatggccaccatcgggatcgccctgctctcccagagcaccatcccggagaccatcctggagctgacggacgccctcgccctgggcatgatggtgctgaagatcgtccgcaacatggagaagtaccagctcgcggtgaccatcatggccatctcctgcgtgcccaacgccgtcatcctgcagaacgcctggaaggtgagctgcaccatcctggcgaccgtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtggggatggtcagcatcctcgcctccagcctgctgaagaacgacatccccatgaccggccccctcgtggccgggggcctgctgaccgtgtgctacgtcctcacggggcggagcgccgacctggagctggagcgcgccaccgacgtgaagtgggaggaccaggcggagatctccggcagctccccgatcctcagcatcaccatcgccgaggacggctccatgagcatcaagaacgaggaggaggagcagaccctgacgatcctgatccggaccgggctcctggtgatctccggcctgttccccgtcagcatccccatcaccgccgccgcctggtacctctgggaggtgaagaagcagcgcgcgggggtgctgtgggacgtcccctccccgccgcccgtgggcaaggccgagctggaggacggggcctaccggatcaagcagaagggcatcctcggctacagccagatcggggccggcgtgtacaaggaggggaccttccacaccatgtggcacgtcacgcgcggcgccgtgctgatgcaccgggggaagcgcatcgagccgtcctgggcggacgtgaagaaggacctgatcagctacggcggcgggtggaagctcgagggcgagtggaaggagggggaggaggtccaggtgctggccctggagcccggcaagaacccccgggccgtgcagaccaagcccggcctcttcaagaccaacaccggcacgatcggcgccgtctccctggacttcagcccggggacctccggcagccccatcgtggaccgcaaggggaaggtggtcggcctgtacggcaacggggtggtgacccggtccggcgcgtacgtcagcgccatcgcccagaccgagaagtccatcgaggacaaccccgagatcgaggacgacatcttccgcaagaagcggctcacgatcatggacctgcaccccggggccggcaagaccaagcgctacctgccggccatcgtgcgggaggcgatcaagcgcgggctgcggaccctcatcctggcccccacccgcgtggtcgccgccgagatggaggaggccctgcgcggcctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcgggtacatctccacccgggtggagatgggcgaggccgccgggatcttcatgaccgcgacgccgcccggcagccgcgaccccttcccccagtccaacgcccccatcatggacgaggagcgggagatccccgagcgcagctggaactccgggcacgagtgggtgacggacttcaagggcaagaccgtctggttcgtgcccagcatcaaggccggcaacgacatcgccgcctgcctgcggaagaacgggaagaaggtgatccagctctcccgcaagaccttcgacagcgagtacgtcaagacccggacgaacgactgggacttcgtggtgaccaccgacatctccgagatgggcgcgaacttcaaggccgagcgcgtcatcgacccccggcgctgcatgaagcccgtgatcctgaccgacggggaggagcgggtgatcctggccggcccgatgcccgtcacgcacagctccgccgcccagcgccgggggcgcatcggccgcaaccccaagaacgagaacgaccagtacatctacatgggcgagcccctcgagaacgacgaggactgcgcgcactggaaggaggccaagatgctgctggacaacatcaacaccccggaggggatcatccccagcatgttcgagcccgagcgggagaaggtggacgccatcgacggcgagtaccgcctccgcggggaggcccgcaagaccttcgtggacctgatgcggcgcggcgacctgccggtctggctcgcctaccgggtggcggccgaggggatcaactacgccgaccgccggtggtgcttcgacggcgtgaagaacaaccagatcctggaggagaacgtcgaggtggagatctggaccaaggagggcgagcgcaagaagctgaagccccggtggctcgacgcccgcatctactccgaccccctggcgctgaaggagttcaaggagttcgccgccgggcgcaagagcctcacgctgaacctgatcaccgagatgggccgcctccccaccttcatgacccagaaggcccgggacgccctggacaacctggcggtgctccacacggccgaggccgggggccgcgcctacaaccacgccctgtccgagctgccggagaccctcgagaccctgctgctcctgaccctgctcgcgacggtcaccggcgggatcttcctgttcctgatgagcggcaagggggtgggcaagatgaccctcgggatgtgctgcatcatcaccgcctccatcctgctgtggcacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatgggcttcctcgagaagaccaagaaggacctgggcctggggtccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatgggcctcgggaagggctggccgctgtccaagatggacatcggggtgcccctgctcgccatcggctgctacagccaggtgaaccccatcaccctgacggccgcgctgctcctgctggtcgcccactacgccatcatcggccccgggctccaggccaaggccacccgcgaggcgcagaagcgggccgccgccggcatcatgaagaacccgaccgtggacgggatcaccgtgatcgacctggaccccatcccctacgaccccaagttcgagaagcagctgggccaggtcatgctcctgatcctgtgcgtgacccaggtgctcatgatgcgcaccacctgggccctgtgcgaggcgctgaccctcgccacggggccgatctccaccctgtgggagggcaaccccggccgcttctggaacaccaccatcgccgtcagcatggccaacatcttccgggggtcctacctggcgggcgccgggctcctgttcagcatcatgaagaacacgaccaacacccgccggggcaccggcaacatcggggagacgctgggcgagaagtggaagtcccgcctcaacgccctgggcaagagcgagttccagatctacaagaagtccggcatccaggaggtggaccggaccctggccaaggaggggatcaagcgcggcgagaccgaccaccacgccgtgagccggggctccgcgaagctccgctggttcgtcgagcggaacatggtgacccccgaggggaaggtggtcgacctgggctgcgggcgcggcgggtggagctactactgcggcggcctgaagaacgtgcgggaggtgaaggggctcacgaagggcgggcccggccacgaggagccgatccccatgtccacctacgggtggaacctggtccgcctgcagagcggcgtggacgtgttcttcacgccgcccgagaagtgcgacaccctcctgtgcgacatcggcgagtccagcccgaaccccacgatcgaggccgggcggaccctgcgcgtcctcagcctggtggagaactggctgaacaacgacacccagttctgcatcaaggtgctcaacccctacatgccgtccgtcatcgagaagatggagaccctgcagcggaagtacggcggggccctggtgcgcaaccccctgagccggaactccacccacgagatgtactgggtgagcaacgccacgggcaacatcgtctccagcgtgaacatgatctcccgcatgctcatcaaccggttcaccatgaagcacaagaaggccacctacgagcccgacgtggacctggggagcggcacccgcaacatcggcatcgagtccgagatccccaacctggacatcatcgggaagcgcatcgagaagatcaagcaggagcacgagacgagctggcactacgaccaggaccacccgtacaagacctgggcgtaccacggctcctacgagaccaagcagaccgggagcgcctccagcatggtcaacggcgtggtgcggctcctgacgaagccctgggacgtcgtgcccatggtgacccagatggccatgaccgacaccacgcccttcggccagcagcgcgtcttcaaggagaaggtggacacccggacccaggagccgaaggaggggaccaagaagctgatgaagatcacggccgagtggctctggaaggagctgggcaagaagaagacgccccggatgtgcacccgggaggagttcacccgcaaggtgcggtccaacgccgcgctgggggccatcttcacggacgagaacaagtggaagtccgcccgcgaggccgtcgaggactcccggttctgggagctcgtggacaaggagcgcaacctgcacctggagggcaagtgcgagacctgcgtgtacaacatgatggggaagcgggagaagaagctcggcgagttcggcaaggcgaaggggagccgcgccatctggtacatgtggctgggcgcccggttcctggagttcgaggccctcgggttcctgaacgaggaccactggttctcccgcgagaacagcctgagcggcgtcgagggggagggcctccacaagctgggctacatcctgcgggacgtgtccaagaaggagggcggggccatgtacgcggacgacaccgccgggtgggacacccgcatcacgctcgaggacctgaagaacgaggagatggtcaccaaccacatggagggcgagcacaagaagctggccgaggccatcttcaagctcacctaccagaacaaggtggtgcgggtccagcgccccacgccccgggggacggtgatggacatcatcagccgccgggaccagcgcggctccggccaggtggggacctacggcctgaacaccttcaccaacatggaggcccagctgatccgccagatggagggggagggcatcttcaagagcatccagcacctcacggtcaccgaggagatcgcggtgcagaactggctggcccgggtgggccgcgagcggctgtcccgcatggccatcagcggggacgactgcgtcgtgaagccgctcgacgaccggttcgcctccgccctgaccgcgctgaacgacatgggcaaggtgcgcaaggacatccagcagtgggagcccagccgggggtggaacgactggacccaggtccccttctgctcccaccacttccacgagctcatcatgaaggacggccgcgtgctggtggtcccctgccggaaccaggacgagctgatcgggcgcgcccggatcagccagggcgccggctggtccctcaaggagacggcctgcctgggcaagagctacgcccagatgtggtccctgatgtacttccaccgccgggacctccgcctggcggccaacgccatctgcagcgccgtgccgtcccactgggtgcccaccagccggaccacctggtccatccacgcgaagcacgagtggatgaccacggaggacatgctgaccgtctggaaccgcgtgtggatccaggagaacccctggatggaggacaagacccccgtggagagctgggaggaggtcccgtacctcggcaagcgggaggaccagtggtgcgggagcctgatcggcctgacctcccgcgccacgtgggccaagaacatccagaccgccatcaaccaggtgcggagcctcatcgggaacgaggagtacaccgactacatgccctccatgaagcgcttccgccgggaggaggaggaggccggcgtgctgtggtga

SEQ ID NO: 9657 - RNA, 9876 nt, synthetic construct
  misc_feature 1..9876: note = derived and/or modified CDS sequence (opt1) from DENV-2__FM210213__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcgccgtgagcttcgtgaccctgatcacggggaacatgtccttccgggacctgggccgcgtcatggtgatggtgggggccgcgatgaccgacgacatcggcatgggcgtcacctacctcgccctgctggccgccttcaaggtgcgccccaccttcgccgcggggctcctgctgcggaagctcacgagcaaggagctgatgatggccaccatcggcatcgccctgctctcccagagcaccatcccggagaccatcctggagctgacggacgccctcgccctggggatgatggtgctgaagatcgtccgcaacatggagaagtaccagctcgcggtgaccatcatggccatctcctgcgtgcccaacgccgtcatcctgcagaacgcctggaaggtgagctgcaccatcctggcgaccgtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggggcgaacttcaaggccgagcgcgtcatcgacccccggcgctgcatgaagcccgtgatcctgaccgacggcgaggagcgggtgatcctggccgggccgatgcccgtcacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgggagaaggtggacgccatcgacggggagtaccgcctccggggcgaggcccgcaagaccttcgtggacctgatgcggcgcggggacctgccggtctggctcgcctaccgggtggcggccgagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcccgcatctactccgaccccctggcgctgaaggagttcaaggagttcgccgccggccgcaagagcctcacgctgaacctgatcaccgagatggggcgcctccccaccttcatgacccagaaggcccggaacgccctggacaacctggcggtgctccacacggccgaggccggcgggcgcgcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggcacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgcgaggcgcagaagcgggccgccgccgggatcatgaagaacccgaccgtggacggcatcaccgtgatcgacctggaccccatcccctacgaccccaagttcgagaagcagctggggcaggtcatgctcctgatcctgtgcgtgacccaggtgctcatgatgcgcaccacctgggccctgtgcgaggcgctgaccctcgccacgggcccgatctccaccctgtgggaggggaaccccggccgcttctggaacaccaccatcgccgtcagcatggccaacatcttccggggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtgagccggggctccgcgaagctccgctggttcgtcgagcggaacatggtgacccccgagggcaaggtggtcgacctggggtgcggccgcgggggctggagctactactgcgggggcctgaagaacgtgcgggaggtgaagggcctcacgaagggcggccccgggcacgaggagccgatccccatgtccacctacggctggaacctggtccgcctgcagagcggggtggacgtgttcttcacgccgcccgagaagtgcgacaccctcctgtgcgacatcggcgagtccagcccgaaccccacgatcgaggccggccggaccctgcgcgtcctcagcctggtggagaactggctgaacaacgacacccagttctgcatcaaggtgctcaacccctacatgccgtccgtcatcgagaagatggagaccctgcagcggaagtacgggggcgccctggtgcgcaaccccctgagccggaactccacccacgagatgtactgggtgagcaacgccacggggaacatcgtctccagcgtgaacatgatctcccgcatgctcatcaaccggttcaccatgaagcacaagaaggccacctacgagcccgacgtggacctgggcagcgggacccgcaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtcaacggggtggtgcggctcctgacgaagccctgggacgtcgtgcccatggtgacccagatggccatgaccgacaccacgcccttcggccagcagcgcgtcttcaaggagaaggtggacacccggacccaggagccgaaggagggcaccaagaagctgatgaagatcacggccgagtggctctggaaggagctggggaagaagaagacgccccggatgtgcacccgggaggagttcacccgcaaggtgcggtccaacgccgcgctgggcgccatcttcacggacgagaacaagtggaagtccgcccgcgaggccgtcgaggactcccggttctgggagctcgtggacaaggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtcgagggcgaggggctccacaagctgggctacatcctgcgggacgtgtccaagaaggagggcggggccatgtacgcggacgacaccgccggctgggacacccgcatcacgctcgaggacctgaagaacgaggagatggtcaccaaccacatggagggggagcacaagaagctggccgaggccatcttcaagctcacctaccagaacaaggtggtgcgggtccagcgccccacgccccggggcacggtgatggacatcatcagccgccgggaccagcgcgggtccggccaggtgggcacctacgggctgaacaccttcaccaacatggaggcccagctgatccgccagatggagggcgaggggatcttcaagagcatccagcacctcacggtcaccgaggagatcgcggtgcagaactggctggcccgggtgggccgcgagcggctgtcccgcatggccatcagcggcgacgactgcgtcgtgaagccgctcgacgaccggttcgcctccgccctgaccgcgctgaacgacatggggaaggtgcgcaaggacatccagcagtgggagcccagccggggctggaacgactggacccaggtccccttctgctcccaccacttccacgagctcatcatgaaggacgggcgcgtgctggtggtcccctgccggaaccaggacgagctgatcggccgcgcccggatcagccagggggccggctggtccctcaaggagacggcctgcctgggcaagagctacgcccagatgtggtccctgatgtacttccaccgccgggacctccgcctggcggccaacgccatctgcagcgccgtgccgtcccactgggtgcccaccagccggaccacctggtccatccacgcgaagcacgagtggatgaccacggaggacatgctgaccgtctggaaccgcgtgtggatccaggagaacccctggatggaggacaagacccccgtggagagctgggaggaggtcccgtacctcgggaagcgggaggaccagtggtgcggcagcctgatcgggctgacctcccgcgccacgtgggccaagaacatccagaccgccatcaaccaggtgcggagcctcatcggcaacgaggagtacaccgactacatgccctccatgaagcgcttccgccgggaggaggaggaggccggggtgctgtggtga

SEQ ID NO: 9658 - RNA, 9876 nt, synthetic construct
  misc_feature 1..9876: note = derived and/or modified CDS sequence (opt1) from DENV-2__FM210235__SS-prME
  source 1..9876: mol_type = other RNA
accgccggcgtgatcatcatgctgatccccaccgccatggcgttccacctcaccacccggaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatcagcaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgccggcactccatggtggaccgcggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccggaccggcctcgacttcaacgagatggtgctgctgcagatggaggacaaggcgtggctcgtccaccgccagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccggctgcgcatggacaagctccagctgaaggggatgagctactccatgtgcaccggcaagttcaagatcgtcaaggagatcgccgagacccagcacgggaccatcgtgatccgggtgcagtacgagggcgacggcagcccctgcaagatcccgttcgagatcatggacctggagaagcgccacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcggggcgccaagcgcatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccggagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccgctccgtgacccggctggagaacctcatgtggaagcagatcaccccggagctgaaccacatcctgagcgagaacgaggtcaagctcaccatcatgacgggcgacatcaaggggatcatgcaggccggcaagcgctccctgcggccccagcccaccgagctgaagtacagctggaagacctggggcaaggccaagatgctctccaccgagagccacaaccagacgttcctgatcgacgggccggagaccgccgagtgccccaacaccaaccgcgcctggaactccctggaggtggaggactacggcttcggggtgttcaccacgaacatctggctcaagctgcgggagaagcaggacgtcttctgcgacagcaagctgatgtccgcggccatcaaggacaaccgcgccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccggcccggctactacacccagaccgccgggccctggcacctcggcaagctggagatggacttcgacttctgcgaggggacgaccgtggtcgtgaccgaggactgcggcaaccgcggccccagcctgcggaccacgaccgccagcgggaagctcatcaccgagtggtgctgccgctcctgcaccctgccgcccctgcggtaccgcggcgaggacgggtgctggtacggcatggagatccggcccctcaaggagaaggaggagaacctggtgaacagcctggtcacggcggggcacggccagatcgacaacttctccctcggcgtgctggggatggccctgttcctcgaggagatgctgcgcacccgggtgggcaccaagcacgccatcctgctcgtcaccgtgagcttcgtgacgctgatcaccgggaacatgtccttccgcgacctgggccgcgtcatggtgatggtgggggccgccatgaccgacgacatcggcatgggcgtcacctacctcgcgctgctggccgccttcaaggtgcggcccacgttcgccgccgggctcctgctgcgcaagctcaccagcaaggagctgatgatggcgaccatcggcatcgccctgctctcccagagcaccatcccggagacgatcctggagctgaccgacgccctcgccctggggatgatggtgctgaagatcgtccggaacatggagaagtaccagctcgccgtgaccatcatggcgatctcctgcgtgcccaacgccgtcatcctgcagaacgcctggaaggtgagctgcaccatcctggccgcggtgtccgtcagccccctcctgctgacgtccagccagcagaaggccgactggatccccctcgagtggtccatcaagggcctgaacccgaccgccatcttcctgaccaccctcagccgcacgtccaagaagcggagctggcccctgaacgaggccatcatggccgtgggcatggtctccatcctggcgagcagcctcctgaagaacgacatccccatgaccgggcccctggtggccggcgggctcctgaccgtgtgctacgtcctgaccggccgctccgccgacctcgagctggagcgggccacggacgtgaagtgggaggaccaggccgagatcagcgggtccagcccgatcctgtccatcaccatcgcggaggacggcagcatgtccatcaagaacgaggaggaggagcagaccctcaccatcctgatccgcacgggcctgctcgtgatcagcgggctgttccccgtctccatccccatcaccgccgccgcctggtacctgtgggaggtgaagaagcagcgggccggcgtgctctgggacgtccccagcccgccgcccgtggggaaggcggagctggaggacggcgcctaccgcatcaagcagaaggggatcctgggctactcccagatcggcgccggggtgtacaaggagggcaccttccacaccatgtggcacgtcacccgcggggccgtgctcatgcaccgcggcaagcggatcgagccgagctgggccgacgtgaagaaggacctgatctcctacgggggcggctggaagctggagggggagtggaaggagggcgaggaggtccaggtgctcgcgctggagcccgggaagaacccccgcgccgtgcagacgaagcccggcctgttcaagaccaacaccgggaccatcggcgccgtcagcctcgacttctccccgggcacgagcgggtcccccatcgtggaccggaagggcaaggtggtcgggctgtacggcaacggcgtggtgacccgcagcggggcctacgtctccgcgatcgcccagaccgagaagtccatcgaggacaaccccgagatcgaggacgacatcttccggaagaagcgcctgaccatcatggacctccaccccggcgccgggaagacgaagcggtacctgccggccatcgtgcgcgaggccatcaagcggggcctgcgcaccctgatcctcgcgcccacccgcgtggtcgccgccgagatggaggaggccctgcgggggctgcccatccgctaccagacccccgccatccgggcggagcacacgggccgcgagatcgtggacctcatgtgccacgccaccttcaccatgcggctgctgagcccggtgcgcgtccccaactacaacctcatcatcatggacgaggcccacttcaccgaccccgcctccatcgccgcgcggggctacatcagcacgcgcgtggagatgggggaggccgccggcatcttcatgaccgccacgccgcccgggtcccgggaccccttcccccagagcaacgcgcccatcatggacgaggagcgcgagatccccgagcggtcctggaacagcggccacgagtgggtgaccgacttcaaggggaagacggtctggttcgtgccctccatcaaggccggcaacgacatcgccgcctgcctgcgcaagaacggcaagaaggtgatccagctgagccggaagaccttcgactccgagtacgtcaagacccgcaccaacgactgggacttcgtggtgacgaccgacatcagcgagatgggggccaacttcaaggcggagcgggtcatcgacccccgccggtgcatgaagcccgtgatcctcaccgacggcgaggagcgcgtgatcctggccgggccgatgcccgtcacccactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacgccggagggcatcatcccctccatgttcgagcccgagcgcgagaaggtggacgccatcgacggggagtaccggctgcgcggcgaggcccggaagaccttcgtggacctcatgcgccgcggggacctgccggtctggctggcctaccgcgtggccgcggagggcatcaactacgccgaccggcgctggtgcttcgacggggtgaagaacaaccagatcctcgaggagaacgtcgaggtggagatctggaccaaggagggcgagcggaagaagctgaagccccgctggctggacgcccggatctacagcgaccccctcgccctgaaggagttcaaggagttcgcggccggccgcaagtccctgaccctcaacctgatcacggagatggggcggctgcccaccttcatgacccagaaggcccgcgacgccctcgacaacctggccgtgctgcacaccgcggaggccggcgggcgggcctacaaccacgccctcagcgagctgccggagacgctggagaccctcctgctgctcaccctgctggccaccgtcacgggcggcatcttcctcttcctgatgtccgggaagggcgtggggaagatgaccctgggcatgtgctgcatcatcaccgcgagcatcctcctgtggtacgcccagatccagccccactggatcgccgcctccatcatcctggagttcttcctcatcgtcctgctgatccccgagcccgagaagcagcgcaccccgcaggacaaccagctcacctacgtggtgatcgccatcctgacggtcgtggcggccaccatggccaacgagatggggttcctggagaagaccaagaaggacctcggcctgggcagcatcgccacccgggagcccgagagcaacatcctggacatcgacctccgccccgcctccgcgtggacgctgtacgccgtggccaccaccttcgtcacccccatgctgcggcacagcatcgagaactccagcgtgaacgtgtccctcacggccatcgcgaaccaggccaccgtcctgatggggctgggcaaggggtggccgctcagcaagatggacatcggcgtgcccctgctggccatcgggtgctactcccaggtgaaccccatcaccctcaccgccgccctgctgctcctggtcgcgcactacgccatcatcggccccggcctgcaggccaaggccacgcgcgaggcccagaagcgcgcggccgccgggatcatgaagaacccgaccgtggacggcgtgaccgtcatcgacctcgaccccatcccctacgaccccaagttcgagaagcagctgggccaggtgatgctgctcatcctgtgcgtgacccaggtcctgatgatgcggacgacctgggccctctgcgaggccctgaccctggcgaccggcccgatcagcacgctctgggaggggaaccccggccgcttctggaacaccaccatcgccgtgtccatggccaacatcttccggggcagctacctggccggggcgggcctcctgttctccatcatgaagaacaccacgaacacccgccgggggaccggcaacatcggcgagaccctgggggagaagtggaagtcccgcctgaacgccctcggcaagtccgagttccagatctacaagaagtccgggatccaggaggtggaccggacgctggccaaggagggcatcaagcgcggggagaccgaccaccacgccgtctcccggggcagcgccaagctgcgctggttcgtggagcggaacatggtgacccccgagggcaaggtcgtggacctcgggtgcggccgcgggggctggtcctactactgcgggggcctgaagaacgtgcgggaggtcaagggcctgaccaagggcgggcccgggcacgaggagccgatccccatgagcacgtacggctggaacctcgtgcgcctgcagtccggggtggacgtcttcttcacgccgcccgagaagtgcgacaccctgctctgcgacatcggcgagagcagcccgaaccccaccatcgaggcgggccggacgctgcgcgtgctgtccctcgtggagaactggctgaacaacgacacccagttctgcatcaaggtcctgaacccctacatgccgagcgtgatcgagaagatggagaccctccagcggaagtacgggggcgccctggtgcgcaaccccctgtcccggaacagcacccacgagatgtactgggtctccaacgccaccgggaacatcgtgagctccgtgaacatgatcagccgcatgctgatcaaccgcttcacgatgaagcacaagaaggccacctacgagcccgacgtcgacctcggctccgggacccggaacatcggcatcgagagcgagatccccaacctggacatcatcggcaagcgcatcgagaagatcaagcaggagcacgagacctcctggcactacgaccaggaccacccgtacaagacgtgggcctaccacgggagctacgagaccaagcagaccggctccgcgagctccatggtgaacggggtggtccggctgctcaccaagccctgggacgtggtgcccatggtcacgcagatggccatgaccgacaccacccccttcggccagcagcgcgtgttcaaggagaaggtggacacgcggacccaggagccgaaggagggcaccaagaagctgatgaagatcaccgccgagtggctgtggaaggagctcgggaagaagaagacgccccgcatgtgcacccgggaggagttcacccgcaaggtccggagcaacgccgccctgggcgcgatcttcaccgacgagaacaagtggaagtccgcccgcgaggccgtggaggacagccggttctgggagctggtggacaaggagcgcaacctccacctggaggggaagtgcgagacgtgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgagaacagcctgtccggggtggagggcgaggggctgcacaagctcggctacatcctgcgggacgtcagcaagaaggagggcggggccatgtacgccgacgacaccgcgggctgggacacccgcatcaccctggaggacctcaagaacgaggagatggtgacgaaccacatggagggggagcacaagaagctggccgaggccatcttcaagctgacctaccagaacaaggtggtccgggtgcagcgccccacgccccggggcaccgtgatggacatcatctcccgccgcgaccagcgggggagcggccaggtcggcacgtacgggctcaacaccttcaccaacatggaggcccagctgatccgccagatggagggcgagggggtgttcaagtccatccagcggctgaccgtgacggaggagatcgccgtccagaactggctcgcgcgcgtgggccgggagcgcctgagccggatggccatctccggcgacgactgcgtggtcaagccgctggacgaccgcttcgccagcgccctcaccgccctgaacgacatggggaaggtgcggaaggacatccagcagtgggagccctcccgcggctggaacgactggacccaggtgcccttctgcagccaccacttccacgagctgatcatgaaggacgggcgggtcctcgtggtgccctgccgcaaccaggacgagctgatcggccgggcgcgcatctcccagggggccggctggagcctgaaggagaccgcctgcctcggcaagtcctacgcccagatgtggagcctgatgtacttccaccggcgcgacctgcggctcgccgcgaacgccatctgctccgccgtcccgagccactgggtgcccacgtcccgcaccacctggagcatccacgccaagcacgagtggatgaccaccgaggacatgctgacggtgtggaaccgggtctggatccaggagaacccctggatggaggacaagacccccgtggagagctgggaggaggtgccgtacctggggaagcgcgaggaccagtggtgcggctccctcatcgggctgaccagccgcgcgacctgggccaagaacatccagacggccatcaaccaggtccggtccctgatcggcaacgaggagtacaccgactacatgcccagcatgaagcgcttccggcgcgaggaggaggaggccggggtgctctggtga

SEQ ID NO: 9659 - RNA, 9876 nt, synthetic construct
  misc_feature 1..9876: note = derived and/or modified CDS sequence (opt1) from DENV-2__FM210205__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctcttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctcaagaagctgacctccaaggagctgatgatgaccacgatcgggatcgtcctcctgagccagtccaccatccccgagaccgtgctggagctcaccgacgccctggcgctgggcatgatggtgctcaagatcgtccggaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgggagatcgtggacctcatgtgccacgccaccttcaccatgcgcctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccgcaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacttcgggctcggctccatcgccacgcagcagccggagagcaacatcctggacatcgacctgcggcccgcctccgcctggaccctctacgcggtggccaccaccttcgtgacgcccatgctgcgccacagcatcgagaacagctccgtcaacgtgagcctgaccgccatcgccaaccaggccaccgtgctcatgggcctggggaagggctggcccctgtccaagatggacatcggggtcccgctcctggcgatcggctgctacagccaggtgaaccccatcaccctgacggccgccctcctgctgctcgtggcccactacgcgatcatcgggcccggcctgcaggccaaggccacccgggaggcccagaagcgcgccgcggccggcatcatgaagaaccccaccgtcgacgggatcaccgtgatcgacctggacccgatcccctacgaccccaagttcgagaagcagctcggccaggtgatgctgctgatcctctgcgtcacccaggtgctgatgatgcggaccacctgggccctgtgcgaggccctcaccctggccacggggcccatctccaccctgtgggagggcaacccggggcgcttctggaacaccaccatcgcggtgagcatggccaacatcttccggggctcctacctcgccggcgccgggctgctgttcagcatcatgaagaacacgaccaacacccgccggggcaccgggaacatcggcgagacgctcggcgagaagtggaagtcccgcctgaacgccctgggcaagagcgagttccagatctacaagaagtccggcatccaggaggtcgaccgcaccctcgcgaaggaggggatcaagcggggcgagaccgaccaccacgccgtgagccgcgggtccgccaagctgcggtggttcgtggagcgcaacatggtcacccccgagggcaaggtggtggacctgggctgcgggcggggcgggtggagctactactgcggcgggctcaagaacgtccgcgaggtgaagggcctgacgaagggcgggcccggccacgaggagcccatcccgatgtccacctacgggtggaacctggtgcggctccagagcggcgtcgacgtgttcttcatcccgcccgagaagtgcgacaccctgctgtgcgacatcggggagtccagccccaacccgaccgtggaggccggccgcacgctccgggtcctgaacctggtggagaactggctcaacaacaacacccagttctgcatcaaggtgctgaacccctacatgccctccgtcatcgagaagatggaggcgctgcagcgcaagtacggcggggccctggtgcggaacccgctcagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctggggagcggcacgcgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagaccaagcagacggggagcgcgtccagcatggtcaacggcgtggtgcgcctgctgaccaagccgtgggacgtcctccccaccgtgacccagatggccatgacggacaccacccccttcgggcagcagcgggtgttcaaggagaaggtcgacacccgcacgcaggagcccaaggagggcaccaagaagctgatgaagatcaccgccgagtggctgtggaaggagctcggcaagaagaagaccccgcgcatgtgcacgcgggaggagttcacccgcaaggtgcggtccaacgccgccctgggggcgatcttcaccgacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggccaagggcagccgcgccatctggtacatgtggctcggcgcgcggttcctggagttcgaggccctggggttcctcaacgaggaccactggttctcccgcgagaacagcctgtccggcgtcgagggggagggcctgcacaagctcgggtacatcctgcgggacgtgagcaagaaggagggcggcgccatgtacgccgacgacacggcggggtgggacacccgcatcaccctggaggacctcaagaacgaggagatggtgaccaaccacatggagggcgagcacaagaagctggccgaggccatcttcaagctgacgtaccagaacaaggtcgtgcgggtgcagcgccccacgccccgggggaccgtcatggacatcatcagccgccgggaccagcgcggctccggccaggtggggacctacggcctcaacacgttcaccaacatggaggcccagctgatccggcagatggagggggagggcgtgttcaagaacatccagcacctgaccgtcaccgaggaggtggccgtgcagaactggctcgcgcgcgtcgggcgggagcgcctgagccgcatggccatctccggcgacgactgcgtggtgaagcccctggacgaccggttcgccaacgccctcacggccctgaacgacatgggcaagatccgcaaggacatccagcagtgggagccgagcaaggggtggaacgactggacccaggtccccttctgctcccaccacttccacgagctgatcatgaaggacggccgggtgctcgtggtcccctgccgcaaccaggacgagctgatcgggcgggcgcgcatcagccagggcgccgggtggtccctgcgggagaccgcctgcctcggcaagagctacgcccagatgtggtccctgatgtacttccaccgccgggacctgcgcctcgccgcgaacgccatctgcagcgccgtgccctcccactgggtgccgaccagccggacgacctggtccatccacgccaagcacgagtggatgaccaccgaggacatgctgaccgtctggaaccgcgtgtggatccgggagaacccctggatggaggacaagacgcccgtggagagctgggaggagatcccctacctgggcaagcgcgaggaccagtggtgcgggtccctcatcggcctgaccagccgggccacctgggcgaagaacatccaggccgccatcaaccaggtccgctccctgatcgggaacgaggagtacaccgactacatgccgagcatgaagcggttccgccgggaggaggaggaggccggcgtgctctggtga

SEQ ID NO: 9660 - RNA, 9876 nt, synthetic construct
  misc_feature 1..9876: note = derived and/or modified CDS sequence (opt1) from DENV-2__FM210206__SS-prME
  source 1..9876: mol_type = other RNA
agcgcgggcatgatcatcatgctgatccccaccgtgatggccttccacctcaccacccggaacggggagccgcacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcaccccggcttcacgctgatggccgcgatcctcgcctacaccatcgggaccacccacttccagcgcgtcctgatcttcatcctgctcacggccgtggccccctccatgaccatgcggtgcatcggcatcagcaaccgcgacttcgtggagggcgtctccgggggcagctgggtggacatcgtgctggagcacgggtcctgcgtcaccaccatggcgaagaacaagcccacgctggacttcgagctcatcaagaccgaggccaagcagcccgccaccctgcggaagtactgcatcgaggccaagctgaccaacacgaccaccgagagccgctgcccgacccagggcgagccctccctcaaggaggagcaggacaagcggttcgtgtgcaagcacagcatggtggaccgcggctgggggaacggctgcgggctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctcaccgggtacggcaccgtcacgatggagtgcagcccccggaccggcctggacttcaacgagatggtgctgctccagatggagaacaaggcctggctggtgcaccgccagtggttcctggacctccccctgccctggctgccgggggccgacaagcaggagtccaactggatccagaaggagaccctcgtcaccttcaagaacccccacgccaagaagcaggacgtggtcgtgctgggcagccaggagggggcgatgcacacggccctgaccggcgccaccgagatccagatgagctccgggaacctcctgttcaccggccacctgaagtgccggctccgcatggacaagctgcagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctcgagaagcgctacgtcctgggccggctgatcaccgtgaacccgatcgtgacggagaaggactcccccgtcaacatcgaggccgagccgcccttcggggacagctacatcatcatcggcgtggagccggggcagctcaagctgaactggttcaagaagggctccagcatcgggcagatgttcgagaccaccatgcgcggcgcgaagcgcatggccatcctgggcgacaccgcctgggacttcgggtccctcggcggggtgttcacgagcatcggcaaggccctgcaccaggtcttcggggccatctacggcgcggccttctccggcgtgagctggaccatgaagatcctgatcggggtgatcatcacctggatcggcatgaactcccggagcacctccctgagcgtctccctcgtgctggtggggatcgtcacgctgtacctcggcgtgatggtgcaggccgacagcgggtgcgtcgtgtcctggaagaacaaggagctgaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctcgagaacctgatgtggaagcagatcacccccgagctgaaccacatcctcgccgagaacgaggtgaagctgaccatcatgaccggggacatcaagggcatcatgcaggccgggaagcgcagcctgcggccgcagcccacggagctcaagtactcctggaagacctggggcaaggccaagatgctgagcatcgagtcctacaaccagaccttcctgatcgacggccccgagaccgcggagtgcccgaacacgaaccgcgcctggaacagcctcgaggtggaggactacgggttcggcgtcttcaccaccaacatctggctgaagctgaaggagaagcaggacgccttctgcgactccaagctcatgagcgccgccatcaaggacaaccgggcggtgcacgccgacatggggtactggatcgagtccgccctgaacgacacctggaagatcgagaaggccagcttcatcgaggtgaagaactgccactggcccaagtcccacacgctgtggagcaacggcgtcctcgagtccgagatgatcatccccaagaacctggccggccccgtgagccagcacaactaccgcccggggtaccacacccagatcgcgggcccctggcacctggggaagctcgagatggacttcgacttctgcgacggcaccaccgtgatcgtcaccgaggactgcgggaaccggggcccctccctgcgcacgaccaccgccagcggcaagctgatcaccgagtggtgctgccggagctgcacgctcccgcccctgcgctaccgcggggaggacggctgctggtacgggatggagatccgccccctgaaggagaaggaggagaacctcgtgaactccctggtgaccgccggccacgggcaggtcgacaacttcagcctgggcgtgctcggcatggccctgttcctggaggagatgctccggacccgcgtggggaccaagcacgcgatcctgctggtcgccgtgtccttcgtgacgctcatcaccggcaacatgagcttcaaggacctggggcgggtcgtggtgatggtcggcgccaccatggccgacgacatcgggatgggcgtgacctacctggccctcctggcggccttcaaggtgcgccccacgttcgccgccggcctgctcctgcggaagctgacctccaaggagctcatgatgaccaccatcgggatcgtcctgctgagccagtccacgatccccgagaccgtgctcgagctgaccgacgccctggcgctcggcatgatggtgctgaagatcgtccgcaacatggagaagtaccagctggccgtgaccatcatggccatcctctgcgtccccaacgccgtgatcctgcagaacgcctggaaggtgagctgcacgatcctggcggtcgtgtccgtgagccccctcctgctgacctccagccagcagaagaccgactggatccccctcgccctgaccatcaaggggctgaaccccacggccatcttcctcaccaccctgtcccgcaccaacaagaagcggagctggccgctgaacgaggccatcatggcggtcggcatggtgtccatcctcgccagctccctgctgaagaacgacatccccatgacgggccccctcgtggccgggggcctgctgaccgtctgctacgtgctcaccgggcgcagcgccgacctggagctggagcgggccaccgacgtgaagtgggaggaccaggcggagatctccggcagcagccccatcctctccatcacgatcagcgaggacgggtccatgagcatcaagaacgaggaggaggagcagaccctgaccatcctgatccgcaccggcctcctggtcatctccggcctgttcccgatcagcatccccatcacggccgccgcctggtacctctgggaggtgaagaagcagcgggccggggtgctgtgggacgtccccagcccgccgcccatgggcaaggcggagctggaggacggggcctaccgcatcaagcagaagggcatcctcgggtacagccagatcggcgccggcgtgtacaaggaggggaccttccacaccatgtggcacgtgacccggggcgccgtcctgatgcacaaggggaagcgcatcgagccctcctgggccgacgtgaagaaggacctgatcagctacggcgggggctggaagctcgagggcgagtggaaggagggggaggaggtgcaggtcctggcgctggagcccggcaagaacccccgggccgtgcagaccaagcccggcctcttcaagacgaacaccggcaccatcggggccgtgtccctggacttcagccccggcacctccggcagccccatcatcgacaagaaggggaaggtcgtgggcctgtacgggaacggcgtggtcacgcgctccggcgcctacgtgagcgccatcgcgcagaccgagaagtccatcgaggacaaccccgagatcgaggacgacatcttccggaagcgccggctgaccatcatggacctccaccccggggccggcaagaccaagcgctacctgcccgccatcgtgcgggaggccatcaagcgcgggctgcggacgctcatcctggcgccgacccgcgtcgtggccgccgagatggaggaggccctgcggggcctccccatccgctaccagacccccgccatccgggcggagcacaccgggcgcgagatcgtggacctgatgtgccacgccacgttcaccatgcgcctgctcagccccgtccgggtgccgaactacaacctgatcatcatggacgaggcccacttcaccgaccccgcctccatcgccgcgcgcggctacatcagcacccgggtggagatgggcgaggccgccgggatcttcatgacggccacgccgcccggcagccgcgacccgttcccccagtccaacgcccccatcatcgacgaggagcgggagatccccgagcgcagctggaactccgggcacgagtgggtcaccgacttcaagggcaagaccgtgtggttcgtgccgagcatcaaggcggggaacgacatcgccgcctgcctgcggaagaacggcaagaaggtcatccagctctcccgcaagacgttcgacagcgagtacgtgaagacccggaccaacgactgggacttcgtggtcaccacggacatctccgagatgggcgccaacttcaaggcggagcgcgtgatcgacccccggcgctgcatgaagcccgtgatcctgaccgacggggaggagcgggtcatcctggccggccccatgccggtgacccacagctccgccgcccagcgccgggggcgcatcggccggaaccccaagaacgagaacgaccagtacatctacatgggggagcccctcgagaacgacgaggactgcgcccactggaaggaggcgaagatgctgctggacaacatcaacacccccgagggcatcatcccgagcatgttcgagcccgagcgcgagaaggtggacgccatcgacggcgagtaccggctccgcggggaggcccgcaagacgttcgtcgacctgatgcggcgcggcgacctgcccgtgtggctcgcctacaaggtggccgcggaggggatcaactacgccgaccggcgctggtgcttcgacggcatcaagaacaaccagatcctggaggagaacgtcgaggtggagatctggaccaaggagggggagcggaagaagctgaagccgcgctggctcgacgcccggatctactccgaccccctggccctgaaggagttcaaggagttcgccgcgggccgcaagagcctcaccctgaacctgatcaccgagatgggccggctccccacgttcatgacccagaagacccgcgacgccctggacaacctggccgtcctccacaccgccgaggccggcgggcgggcctacaaccacgccctgtccgagctgcccgagacgctcgagaccctgctgctcctgaccctgctcgccaccgtgaccgggggcatcttcctgttcctgatgagcggccgcgggatcggcaagatgaccctcgggatgtgctgcatcatcaccgcctccatcctgctgtggtacgcgcagatccagccgcactggatcgccgccagcatcatcctcgagttcttcctgatcgtgctgctcatccccgagcccgagaagcagcggacgccccaggacaaccagctgacctacgtcgtgatcgccatcctgacggtggtcgccgcgaccatggccaacgagatgggcttcctcgagaagaccaagaaggacctggggctgggctccatcgccacccagcagccggagagcaacatcctcgacatcgacctgcgccccgcctccgcctggacgctgtacgcggtggccaccaccttcgtgacccccatgctccggcacagcatcgagaacagctccgtcaacgtgagcctgacggccatcgccaaccaggccaccgtgctgatgggcctcgggaagggctggcccctgtccaagatggacatcggggtcccgctgctcgcgatcggctgctacagccaggtgaaccccatcaccctgaccgccgccctgctcctgctggtggcccactacgcgatcatcgggcccggcctccaggccaaggccacgcgcgaggcccagaagcgggccgcggccggcatcatgaagaaccccaccgtcgacgggatcaccgtgatcgacctggacccgatcccctacgaccccaagttcgagaagcagctgggccaggtgatgctcctgatcctgtgcgtcacccaggtgctcatgatgcgcacgacctgggccctgtgcgaggccctgaccctcgccaccgggcccatctccacgctgtgggagggcaacccggggcggttctggaacaccaccatcgcggtgagcatggccaacatcttccgcggctcctacctggccggcgccgggctcctgttcagcatcatgaagaacaccacgaacacccggcgcggcaccgggaacatgggcgagaccctgggcgagaagtggaagtcccgcctcaacgccctgggcaagagcgagttccagatctacaagaagtccgggatccaggaggtcgaccggacgctggcgaaggaggggatcaagcgcggcgagaccgaccaccacgccgtgagccgggggtccgccaagctccgctggttcgtggagcggaacatggtcacccccgagggcaaggtggtggacctgggctgcgggcgcggcgggtggagctactactgcggcgggctgaagaacgtccgggaggtgaagggcctcaccaagggcgggcccggccacgaggagcccatcccgatgtccacgtacgggtggaacctggtgcgcctgcagagcggcgtcgacgtgttcttcatcccgcccgagaagtgcgacaccctcctgtgcgacatcggggagtccagccccaacccgaccgtggaggccggccggaccctgcgcgtcctcaacctggtggagaactggctgaacaacaacacgcagttctgcatcaaggtgctgaacccctacatgccctccgtcatcgagaagatggaggcgctccagcggaagtacggcggggccctggtgcgcaacccgctgagccggaacagcacccacgagatgtactgggtgtccaacgccagcggcaacatcgtctccagcgtgaacatgatctcccgcatgctcatcaaccggttcaccatgcgccacaagaaggccacctacgagcccgacgtggacctggggagcggcacccggaacatcgggatcgagtccgagatccccaacctggacatcatcggcaagcgcatcgagaagatcaagcaggagcacgagacgagctggcactacgaccaggaccacccctacaagacctgggcctaccacggctcctacgagaccaagcagaccgggagcgcgtccagcatggtcaacggcgtggtgcggctcctgacgaagccgtgggacgtcctgcccaccgtgacccagatggccatgaccgacacgacccccttcgggcagcagcgcgtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgctccaacgccgccctcggggcgatcttcaccgacgagaacaagtggaagtccgcccgggaggccgtggaggactcccgcttctgggagctggtcgacaaggagcggaacctgcacctcgagggcaagtgcgagacctgcgtgtacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttctcccgggagaacagcctctccggcgtcgagggggagggcctgcacaagctggggtacatcctccgcgacgtgagcaagaaggagggcggcgccatgtacgccgacgacaccgcggggtgggacacgcggatcaccctggaggacctgaagaacgaggagatggtgaccaaccacatggagggcgagcacaagaagctcgccgaggccatcttcaagctgacctaccagaacaaggtcgtgcgcgtgcagcggcccacgccccgcgggaccgtcatggacatcatcagccggcgcgaccagcggggctccggccaggtggggacctacggcctgaacaccttcacgaacatggaggcccagctcatccgccagatggagggggagggcgtgttcaagaacatccagcacctgaccgtcaccgaggaggtggccgtgcagaactggctggcgcgggtcgggcgcgagcgcctcagccggatggccatctccggcgacgactgcgtggtgaagcccctggacgaccgcttcgccaacgccctgaccgccctcaacgacatgggcaagatccggaaggacatccagcagtgggagccgagcaaggggtggaacgactggacgcaggtccccttctgctcccaccacttccacgagctgatcatgaaggacggccgcgtgctggtggtcccctgccggaaccaggacgagctcatcgggcgcgcgcggatcagccagggcgccgggtggtccctgcgcgagaccgcctgcctgggcaagagctacgcccagatgtggtccctcatgtacttccaccggcgcgacctgcggctggccgcgaacgccatctgcagcgccgtgccctcccactgggtgccgaccagccgcaccacgtggtccatccacgccaagcacgagtggatgaccaccgaggacatgctcaccgtctggaaccgggtgtggatccgcgagaacccctggatggaggacaagacccccgtggagagctgggaggagatcccctacctgggcaagcgggaggaccagtggtgcgggtccctgatcggcctcacgagccgcgccacctgggcgaagaacatccaggccgccatcaaccaggtccggtccctgatcgggaacgaggagtacaccgactacatgccgagcatgaagcgcttccggcgcgaggaggaggaggccggcgtgctgtggtga

SEQ ID NO: 9661 - RNA, 9876 nt, synthetic construct
  misc_feature 1..9876: note = derived and/or modified CDS sequence (opt1) from DENV-2__FM210246__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtccttcaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggtggccgtgaagaactggctggcgcgggtcgggcgcgagcgcctgagccggatggccatctccggcgacgactgcgtggtgaagcccctcgacgaccgcttcgccaacgccctgacggccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacaccgactacatgccgagcatgaagcgcttccggcgcgaggaggaggaggccggcgtgctgtggtga

SEQ ID NO: 9662 - RNA, 9876 nt, synthetic construct
  misc_feature 1..9876: note = derived and/or modified CDS sequence (opt1) from DENV-2__FM210207__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatgggcgagacgctgggcgagaagtggaagtcccgcctgaacgccctcgggaagaacgagttccagatctacaagaagtccggcatccaggaggtcgaccggaccctggcgaaggaggggatcaagcgcggcgagaccgaccaccacgccgtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgacgaagggcgggcccggccacgaggagcccatcccgatgagcacctacgggtggaacctcgtgcgcctgcagtccggcgtcgacgtgttcttcatcccgcccgagaagtgcgacaccctgctctgcgacatcggggagagctcccccaacccgaccgtggaggccggccggacgctgcgcgtcctgaacctcgtggagaactggctgaacaacaacacccagttctgcatcaaggtgctgaacccctacatgcccagcgtcatcgagaagatggaggcgctgcagcggaagtacggcggggccctcgtgcgcaacccgctgtcccggaacagcacccacgagatgtactgggtgagcaacgcctccggcaacatcgtcagctccgtgaacatgatcagccgcatgctgatcaaccggttcaccatgcgccacaagaaggccacctacgagcccgacgtggacctcgggtccggcacgcggaacatcgggatcgagagcgagatccccaacctggacatcatcggcaagcgcatcgagaagatcaagcaggagcacgagacctcctggcactacgaccaggaccacccctacaagacctgggcctaccacggcagctacgagaccaagcagacggggtccgcgagctccatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgcagcaacgccgccctgggggcgatcttcaccgacgagaacaagtggaagtccgcccgggaggccgtggaggacagccgcttctgggagctcgtcgacaaggagcggaacctgcacctggagggcaagtgcgagacctgcgtgtacaacatgatggggaagcgcgagaagaagctcggcgagttcgggaaggccaagggctcccgggccatctggtacatgtggctgggcgcgcgcttcctggagttcgaggccctcgggttcctgaacgaggaccactggttcagccgggagaactccctgagcggcgtcgagggggagggcctccacaagctggggtacatcctgcgcgacgtgtccaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggcagcggccaggtggggacctacggcctgaacacgttcaccaacatggaggcccagctgatccgccagatggagggggagggcgtgttcaagaacatccagcacctcaccgtcaccgaggaggtggccgtgcagaactggctggcgcgggtcgggcgcgagcgcctgtcccggatggccatcagcggcgacgactgcgtggtgaagcccctcgacgaccgcttcgccaacgccctgacggccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtgcccagccactgggtgccgacctcccgcacgacctggagcatgcacgccaagcacgagtggatgaccaccgaggacatgctgaccgtctggaaccgggtgtggatccgcgagaacccctggatggaggacaagacgcccgtggagtcctgggaggagatcccctacctcggcaagcgggaggaccagtggtgcgggagcctgatcggcctgacctcccgcgccacctgggcgaagaacatccaggccgccatcaaccaggtccggagcctcatcgggaacgaggagtacaccgactacatgccgtccatgaagcgcttccggcgcgaggaggaggaggccggcgtgctgtggtga

SEQ ID NO: 9663 - RNA, 9876 nt, synthetic construct
  misc_feature 1..9876: note = derived and/or modified CDS sequence (opt1) from DENV-2__FM210238__SS-prME
  source 1..9876: mol_type = other RNA
accgccggcatgatcatcatgctgatccccaccgccatggcgttccacctcaccacccgcaacggggagccccacatgatcgtgggccggcaggagaagggcaagagcctgctgttcaagaccgaggacggcgtcaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccgcaccgagacctggatgagctccgagggggcctggaagcacgcccagcggatcgagacctggatcctgcgccacccgggcttcaccatcatggcggccatcctggcctacaccgtggggaccacccacttccagcgggccctcatcttcatcctgctggcggccgtcgcccccagcatgaccatgcgctgcatcggcatctccaaccgggacttcgtggagggcgtgagcgggggctcctgggtcgacatcgtgctcgagcacgggagctgcgtgaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtctgcaagcactccatggtggaccggggctgggggaacggctgcgggctgttcggcaagggcgggatcgtgacgtgcgccatgttcacgtgcaagaagaacatggagggcaagatcgtccagcccgagaacctggagtacaccatcgtgatcacgccccacagcggggaggagcacgccgtgggcaacgacacggggaagcacggcaaggagatcaagatcaccccgcagtcccccatcaccgaggccgagctgaccgggtacggcaccgtcacgatggagtgcagcccccgcaccggcctcgacttcaacgagatggtgctgctgcagatggaggacaaggcgtggctcgtgcaccggcagtggttcctggacctgcccctcccgtggctgcccggggccgacacccagggctccaactggatccagaaggagaccctggtcacgttcaagaacccccacgccaagaagcaggacgtggtggtcctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtgaaggagatcgccgagacccagcacgggaccatcgtcatccgcgtgcagtacgagggcgacggcagcccctgcaagatcccgttcgagatcatggacctggagaagcggcacgtgctcgggcgcctgatcacggtcaaccccatcgtgaccgagaaggactcccccgtgaacatcgaggccgagcccccgttcggcgacagctacatcatcatcggggtcgagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtgttcggggccatctacggcgccgcgttctccggggtcagctggaccatgaagatcctgatcggcgtgatcatcacctggatcgggatgaactcccgcagcacgtccctgagcgtgtccctggtcctcgtgggcgtgatcaccctgtacctgggggccatggtccaggccgacagcggctgcgtggtgtcctggaagaacaaggagctcaagtgcggcagcgggatcttcatcaccgacaacgtccacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtgaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtcgaggactacggcttcggggtgttcaccacgaacatctggctcaagctgcgcgagaagcaggacgtgttctgcgacagcaagctgatgtccgcggccatcaaggacaaccgggccgtccacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtggtcaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtgacggcggggcacggccagatcgacaacttctccctcggcgtcctggggatggccctgttcctcgaggagatgctgcggacccgcgtgggcaccaagcacgccatcctgctcgtgaccgtcagcttcgtgacgctgatcaccgggaacatgtccttccgggacctgggccgcgtgatggtcatggtgggggccgccatgaccgacgacatcggcatgggcgtgacctacctcgcgctgctggccgccttcaaggtccgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtgcgcaacatggagaagtaccagctcgccgtcaccatcatggcgatctcctgcgtgcccaacgccgtgatcctgcagaacgcctggaaggtcagctgcaccatcctggccgcggtgtccgtgagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtcggcatggtgagcatcctcgcctccagcctgctgaagaacgacatccccatgaccgggcccctcgtcgccggcgggctgctgaccgtgtgctacgtgctcacgggccggagcgccgacctggagctggagcgcgccaccgacgtcaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtgagcatccccatcaccgccgccgcctggtacctctgggaggtcaagaagcagcgcgcgggcgtgctgtgggacgtgccctccccgccgcccgtcgggaaggccgagctggaggacggcgcctaccggatcaagcagaaggggatcctcggctacagccagatcggcgccggggtgtacaaggagggcaccttccacaccatgtggcacgtgacgcgcggggccgtcctgatgcaccggggcaagcgcatcgagccgtcctgggcggacgtgaagaaggacctgatcagctacgggggcggctggaagctcgagggggagtggaaggagggcgaggaggtgcaggtcctggccctggagcccgggaagaacccccgggccgtgcagaccaagcccggcctcttcaagaccaacaccgggacgatcggcgccgtgtccctggacttcagcccgggcacctccgggagccccatcgtcgaccgcaagggcaaggtggtggggctgtacggcaacggcgtcgtgacccggtccggggcgtacgtgagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtccgggaggcgatcaagcgcggcctgcggaccctcatcctggcccccacccgcgtggtggccgccgagatggaggaggccctgcgcgggctccccatccggtaccagacgcccgcgatccgcgccgagcacaccggccgggagatcgtcgacctgatgtgccacgccaccttcaccatgcgcctgctcagcccggtgcgggtgcccaactacaacctgatcatcatggacgaggcccacttcacggaccccgccagcatcgcggcccgcggctacatctccacccgggtcgagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtgtggttcgtccccagcatcaaggccggcaacgacatcgccgcctgcctgcggaagaacggcaagaaggtgatccagctctcccgcaagaccttcgacagcgagtacgtgaagacccggacgaacgactgggacttcgtcgtgaccaccgacatctccgagatgggggcgaacttcaaggccgagcgcgtgatcgacccccggcgctgcatgaagcccgtcatcctgaccgacggcgaggagcgggtgatcctggccgggccgatgcccgtgacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgggagaaggtcgacgccatcgacggggagtaccgcctccggggcgaggcccgcaagaccttcgtggacctgatgcggcgcggggacctgccggtgtggctcgcctaccgggtcgcggccgagggcatcaactacgccgaccgccggtggtgcttcgacggggtgaagaacgaccagatcctggaggagaacgtggaggtcgagatctggaccaaggagggcgagcgcaagaagctgaagccccggtggctcgacgcccgcatctactccgaccccctggcgctgaaggagttcaaggagttcgccgccggccgcaagagcctcacgctgaacctgatcaccgagatggggcgcctccccaccttcatgacccagaaggcccgggacgccctggacaacctggcggtgctccacacggccgaggccggcgggcgcgcctacaaccacgccctgtccgagctgccggagaccctcgagaccctgctgctcctgaccctgctcgcgacggtgaccggcggcatcttcctgttcctgatgagcgggaagggcgtcgggaagatgaccctcggcatgtgctgcatcatcaccgcctccatcctgctgtggtacgcccagatccagccccactggatcgccgccagcatcatcctcgagttcttcctgatcgtgctgctcatccccgagcccgagaagcagcggaccccgcaggacaaccagctgacgtacgtcgtgatcgcgatcctgaccgtggtcgccgccaccatggccaacgagatggggttcctcgagaagaccaagaaggacctgggcctgggctccatcgccacgcaggagcccgagagcaacatcctcgacatcgacctgcgccccgcgagcgcctggaccctgtacgccgtggccaccaccttcgtgacgcccatgctccggcactccatcgagaacagctccgtcaacgtgagcctgaccgcgatcgccaaccaggccaccgtgctgatggggctcggcaaggggtggccgctgtccaagatggacatcggcgtccccctgctcgccatcgggtgctacagccaggtgaaccccatcaccctgacggccgcgctgctcctgctggtggcccactacgccatcatcggccccggcctccaggccaaggccacccgcgaggcgcagaagcgggccgccgccgggatcatgaagaacccgaccgtcgacggcatcaccgtgatcgacctggaccccatcccctacgaccccaagttcgagaagcagctgggccaggtgatgctcctgatcctgtgcgtcacccaggtgctcatgatgcgcaccacctgggccctgtgcgaggcgctgaccctcgccacgggcccgatctccaccctgtgggaggggaaccccggccgcttctggaacaccaccatcgccgtgagcatggccaacatcttccggggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtcgaccggaccctggccaaggagggcatcaagcgcggggagaccgaccaccacgccgtgagccggggctccgcgaagctccgctggttcgtggagcggaacatggtcacccccgagggcaaggtggtggacctggggtgcggccgcgggggctggagctactactgcgggggcctgaagaacgtccgggaggtgaagggcctcacgaagggcgggcccgggcacgaggagccgatccccatgtccacctacggctggaacctggtgcgcctgcagagcggggtcgacgtgttcttcacgccgcccgagaagtgcgacaccctcctgtgcgacatcggcgagtccagcccgaaccccacgatcgaggccggccggaccctgcgcgtgctcagcctggtcgagaactggctgaacaacgacacccagttctgcatcaaggtgctcaacccctacatgccgtccgtgatcgagaagatggagaccctgcagcggaagtacgggggcgccctggtccgcaaccccctgagccggaactccacccacgagatgtactgggtgagcaacgccacggggaacatcgtgtccagcgtcaacatgatctcccgcatgctcatcaaccggttcaccatgaagcacaagaaggccacctacgagcccgacgtggacctgggcagcgggacccgcaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtgaacggggtcgtgcggctcctgacgaagccctgggacgtggtccccatggtgacccagatggccatgaccgacaccacgcccttcggccagcagcgcgtgttcaaggagaaggtcgacacccggacccaggagccgaaggagggcaccaagaagctgatgaagatcacggccgagtggctctggaaggagctggggaagaagaagacgccccggatgtgcacccgggaggagttcacccgcaaggtgcggtccaacgccgcgctgggcgccatcttcacggacgagaacaagtggaagtccgcccgcgaggccgtggaggactcccggttctgggagctcgtcgacaaggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtggagggcgaggggctccacaagctgggctacatcctgcgggacgtctccaagaaggagggcggggccatgtacgcggacgacaccgccggctgggacacccgcatcacgctcgaggacctgaagaacgaggagatggtgaccaaccacatggagggggagcacaagaagctggccgaggccatcttcaagctcacctaccagaacaaggtcgtgcgggtgcagcgccccacgccccggggcacggtcatggacatcatcagccgccgggaccagcgcgggtccggccaggtgggcacctacgggctgaacaccttcaccaacatggaggcccagctgatccgccagatggagggcgagggggtgttcaagagcatccagcggctcacggtcaccgaggagatcgcggtgcagaactggctggcccgcgtgggccgggagcgcctgtcccggatggccatcagcggcgacgactgcgtcgtgaagccgctcgacgaccgcttcgcctccgccctgaccgcgctgaacgacatggggaaggtgcggaaggacatccagcagtgggagcccagccgcggctggaacgactggacccaggtccccttctgctcccaccacttccacgagctcatcatgaaggacgggcgggtgctggtggtcccctgccgcaaccaggacgagctgatcggccgggcccgcatcagccagggggccggctggtccctcaaggagacggcctgcctgggcaagagctacgcccagatgtggtccctgatgtacttccaccggcgcgacctccggctggcggccaacgccatctgcagcgccgtgccgtcccactgggtgcccaccagccgcaccacctggtccatccacgcgaagcacgagtggatgaccacggaggacatgctgaccgtctggaaccgggtgtggatccaggagaacccctggatggaggacaagacccccgtggagagctgggaggaggtcccgtacctcgggaagcgcgaggaccagtggtgcggcagcctgatcgggctgacctcccgggccacgtgggccaagaacatccagaccgccatcaaccaggtgcgcagcctcatcggcaacgaggagtacaccgactacatgccctccatgaagcgcttccggcgcgaggaggaggaggccggggtgctgtggtga

SEQ ID NO: 9664 - RNA, 9876 nt, synthetic construct
  misc_feature 1..9876: note = derived and/or modified CDS sequence (opt1) from DENV-2__FM210224__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacacgatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacgtggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgcggagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtgttcggggccatctacggcgccgccttcagcggggtctcctggaccatgaagatcctgatcggcgcgatcatcacgtggatcgggatgaacagccgctccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccgcccgggctactacacccagacggccgggccctggcacctcggcaagctggagatggacttcgacttctgcgaggggaccaccgtcgtggtgaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtcaactccctggtgaccgcggggcacggccagatcgacaacttcagcctcggcgtgctggggatggccctgttcctcgaggagatgctgcggacccgcgtcggcaccaagcacgccatcctgctcgtggccgtgtccttcgtcacgctgatcaccgggaacatgagcttccgggacctgggccgcgtgatggtgatggtcggggccaccatgaccgacgacatcggcatgggcgtgacgtacctcgcgctgctggccgccttcaaggtgcgccccaccttcgccgccgggctcctgctgcggaagctcacctccaaggagctgatgatggcgaccatcggcatcgccctgctcagccagtccacgatccccgagaccatcctggagctgaccgacgccctcgccctggggatgatggtcctgaagatcgtgcgcaacatggagaagtaccagctcgccgtgaccatcatggcgatcagctgcgtcccgaacgccgtgatcctgcagaacgcctggaaggtgtcctgcacgatcctggccgcggtcagcgtgagccccctcctgctgaccagctcccagcagaaggccgactggatccccctcgccctgaccatcaagggcctgaaccccaccgccatcttcctcacgaccctgagccggacctccaagaagcgcagctggccgctgaacgaggccatcatggcggtgggcatggtctccatcctcgccagcagcctgctgaagaacgacatccccatgaccgggcccctcgtggccggcgggctgctgacggtctgctacgtgctcaccggccggtccgccgacctggagctggagcgcgccaccgacgtgaagtgggaggaccaggcggagatcagcgggtccagccccatcctctccatcaccatcagcgaggacggctccatgagcatcaagaacgaggaggaggagcagacgctgaccatcctgatccggaccggcctcctggtcatctccgggctgttcccggtgagcatccccatcaccgccgccgcctggtacctctgggaggtgaagaagcagcgcgccggcgtcctgtgggacgtgcccagcccgccgcccgtggggaaggcggagctggaggacggcgcctaccggatcaagcagaaggggatcctcggctacagccagatcggcgccggggtctacaaggagggcaccttccacacgatgtggcacgtgacccgcggggccgtgctgatgcaccggggcaagcgcatcgagccctcctgggccgacgtcaagaaggacctgatcagctacgggggcggctggaagctcgagggggagtggaaggagggcgaggaggtccaggtgctggcgctggagcccgggaagaacccccgggccgtccagaccaagcccggcctcttcaagaccaacacggggaccatcggcgccgtgtccctggacttcagccccggcacctccgggagccccatcgtggaccgcaagggcaaggtcgtggggctgtacggcaacggcgtggtcacccggtccggggcctacgtgagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcggaccctcatcctggcgccgacgcgcgtcgtggccgccgagatggaggaggccctgcgcgggctccccatccggtaccagacccccgccatccgcgcggagcacaccggccgggagatcgtggacctgatgtgccacgccaccttcacgatgcgcctgctctcccccgtccgggtgccgaactacaacctgatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagtccaacgcgcccatcatcgacgaggagcgggagatccccgagcgcagctggaactccggccacgagtgggtcaccgacttcaaggggaagaccgtgtggttcgtgccgagcatcaaggccggcaacgacatcgccgcctgcctgcggaagaacggcaagaaggtcatccagctctcccgcaagaccttcgacagcgagtacgtgaagacgcggaccaacgactgggacttcgtggtcaccaccgacatctccgagatgggggccaacttcaaggcggagcgcgtgatcgacccccggcgctgcatgaagcccgtgatcctgacggacggcgaggagcgggtcatcctggccgggcccatgccggtgacccacagctccgccgcccagcgccggggccgcatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagaccttcgtcgacctgatgcggcgcggggacctgcccgtgtggctcgcctaccgggtggccgcggagggcatcaactacgccgaccgccggtggtgcttcgacggggccaagaacaaccagatcctggaggagaacgtcgaggtggagatctggacgaaggagggcgagcgcaagaagctgaagccgcggtggctcgacgcccgcatctactccgaccccctggcgctgaaggagttcaaggagttcgccgccggccggaagtccctcaccctgaacctgatcaccgagatggggcgcctccccaccttcatgacgcagaaggcccgggacgccctggacaacctggcggtgctccacaccgccgaggccggcgggcgcgcctacaaccacgccctgtccgagctgcccgagaccctcgagaccctgctgctcctgacgctgctcgcgaccgtcaccggcggcatcttcctgttcctgatgagcgggaagggcgtggggaagatgaccctcggcatgtgctgcatcatcaccgcctccatcctgctgtggtacgcccagatccagccgcactggatcgccgccagcatcatcctcgagttcttcctgatcgtgctgctcatccccgagcccgagaagcagcggacgccccaggacaaccagctgacctacgtcgtgatcgcgatcctgaccgtcgtggccgccaccatggccaacgagatggggttcctcgagaagacgaagaaggacctgggcctgggcagcatcgccacccaggagccggagtccaacatcctcgacatcgacctgcgccccgcgagcgcctggaccctgtacgccgtggccaccacgttcgtcacccccatgctccggcactccatcgagaacagctccgtgaacgtgagcctgaccgcgatcgccaaccaggccaccgtcctgatggggctcggcaaggggtggcccctgtccaagatggacatcggcgtgccgctgctcgccatcgggtgctacagccaggtgaaccccatcacgctgaccgccgcgctgctcctgctgatcgcccactacgccatcatcggccccggcctccaggccaaggccacccgcgaggcgcagaagcgggccgccgccgggatcatgaagaaccccaccgtcgacggcatcacggtgatcgacctggacccgatcccctacgaccccaagttcgagaagcagctgggccaggtgatgctcctgatcctgtgcgtcacccaggtgctcatgatgcgcaccacctgggccctgtgcgaggcgctgacgctcgccaccggccccatctccaccctgtgggaggggaacccgggccgcttctggaacaccacgatcgccgtgagcatggccaacatcttccggggctcctacctggcgggggccggcctcctgttcagcatcatgaagaacaccaccaacacccgccgggggacgggcaacatcggcgagaccctgggggagaagtggaagtcccgcctcaacgccctgggcaagagcgagttccagatctacaagaagtccgggatccaggaggtcgaccggaccctggccaaggagggcatcaagcgcggggagaccgaccaccacgccgtgagccggggctccgcgaagctccgctggttcgtggagcggaacatggtcacgcccgagggcaaggtggtggacctggggtgcggccgcgggggctggagctactactgcgggggcctgaagaacgtccgggaggtgaagggcctcaccaagggcggccccgggcacgaggagcccatcccgatgtccacctacggctggaacctggtgcgcctgcagagcggggtcgacgtgttcttcacgccgcccgagaagtgcgacacgctcctgtgcgacatcggcgagagctcccccaacccgaccatcgaggccggccggaccctgcgcgtgctcagcctggtcgagaactggctgaacaacgacacccagttctgcatcaaggtgctcaacccctacatgccctccgtgatcgagaagatggagaccctgcagcggaagtacgggggcgccctggtccgcaacccgctgagccggaactccacgcacgagatgtactgggtgagcaacgccaccgggaacatcgtgtccagcgtcaacatgatctcccgcatgctcatcaaccggttcaccatgaagcacaagaaggccacctacgagcccgacgtggacctgggcagcgggacgcgcaacatcggcatcgagtccgagatccccaacctggacatcatcggcaagcgcatcgagaagatcaagcaggagcacgagaccagctggcactacgaccaggaccacccctacaagacctgggcgtaccacgggtcctacgagaccaagcagacgggcagcgcctccagcatggtgaacggggtcgtgcggctcctgaccaagccgtgggacgtggtccccatggtgacccagatggccatgaccgacacgacccccttcggccagcagcgcgtgttcaaggagaaggtcgacacccggacccaggagcccaaggagggcacgaagaagctgatgaagatcaccgccgagtggctctggaaggagctggggaagaagaagaccccgcgcatgtgcacccgggaggagttcacgcgcaaggtgcggtccaacgccgcgctgggcgccatcttcaccgacgagaacaagtggaagtccgcccgcgaggccgtggaggactcccggttctgggagctcgtcgacaaggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttcagccgcgagaactccctgagcggggtggagggcgaggggctccacaagctgggctacatcctgcgggacgtctccaagaaggagggcggggccatgtacgcggacgacaccgccggctgggacacgcgcatcaccctcgaggacctgaagaacgaggagatggtgaccaaccacatggagggggagcacaagcggctggccgaggccatcttcaagctcacctaccagaacaaggtggtccgcgtgcagcggcccacgccccgcggcaccgtcatggacatcatcagccggcgcgaccagcgcgggtccggccaggtgggcacctacgggctgaacaccttcacgaacatggaggcccagctgatccggcagatggagggcgaggggatcttcaagagcatccagcacctcaccgtgaccgaggagatcgcggtccagaactggctggcccgcgtgggccgggagcgcctgtcccggatggccatcagcggcgacgactgcgtggtcaagcccctcgacgaccgcttcgcctccgccctgaccgcgctgaacgacatggggaaggtgcggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcccggatcagccagggggccggctggtccctcaaggagaccgcctgcctgggcaagagctacgcccagatgtggtccctgatgtacttccaccgccgggacctccgcctggcggccaacgccatctgcagcgccgtcccctcccactgggtgccgaccagccggaccacctggagcatccacgcgaagcacgagtggatgacgaccgaggacatgctgaccgtgtggaaccgcgtctggatccaggagaacccctggatggaggacaagacccccgtggagtcctgggaggaggtgccctacctcgggaagcgggaggaccagtggtgcggcagcctgatcgggctgacgtcccgcgccacctgggccaagaacatccagaccgccatcaaccaggtccggagcctcatcggcaacgaggagtacaccgactacatgccgtccatgaagcgcttccgccgggaggaggaggaggccggggtgctgtggtga

SEQ ID NO: 9665 - RNA, 9876 nt, synthetic construct
  misc_feature 1..9876: note = derived and/or modified CDS sequence (opt1) from DENV-2__FM210225__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacgtggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggcggacacccagggcagcaactggatccagaaggagacgctggtcaccttcaagaacccccacgccaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgcggagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcgggggcgtgttcacctccatcgggaaggcgctccaccaggtgttcggcgccatctacggcgccgccttcagcggggtctcctggaccatgaagatcctgatcggcgcgatcatcacgtggatcgggatgaacagccgctccaccagcctgtccgtgagcctggtgctcgtcggcgtgatcaccctgtacctgggggccatggtgcaggccgactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcgcacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgcggccatcaaggacaaccgggccgtgcacgccgacatgggctactggatcgagtccgccctcaacgacacctggaagatggagaaggcgagcttcatcgaggtcaagtcctgccactggcccaagagccacaccctgtggtccaacggcgtgctggagagcgagatgatcatccccaagtccttcgccgggcccgtgagccagcacaactaccgcccgggctactacacccagacggccgggccctggcacctcggcaagctggagatggacttcgacttctgcgaggggaccaccgtcgtggtgaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtcaactccctggtgaccgcggggcacggccagatcgacaacttcagcctcggcgtgctggggatggccctgttcctcgaggagatgctgcggacccgcgtcggcaccaagcacgccatcctgctcgtggccgtgtccttcgtcacgctgatcaccgggaacatgagcttccgggacctgggccgcgtgatggtgatggtcggggccaccatgaccgacgacatcggcatgggcgtgacgtacctcgcgctgctggccgccttcaaggtgcgccccaccttcgccgccgggctcctgctgcggaagctcacctccaaggagctgatgatggcgaccatcggcatcgccctgctcagccagtccacgatccccgagaccatcctggagctgaccgacgccctcgccctggggatgatggtcctgaagatcgtgcgcaacatggagaagtaccagctcgccgtgaccatcatggcgatcagctgcgtcccgaacgccgtgatcctgcagaacgcctggaaggtgtcctgcacgatcctggccgcggtcagcgtgagccccctcctgctgaccagctcccagcagaaggccgactggatccccctcgccctgaccatcaagggcctgaaccccaccgccatcttcctcacgaccctgagccggacctccaagaagcgcagctggccgctgaacgaggccatcatggcggtgggcatggtctccatcctcgccagcagcctgctgaagaacgacatccccatgaccgggcccctcgtggccggcgggctgctgacggtctgctacgtgctcaccggccggtccgccgacctggagctggagcgcgccaccgacgtgaagtgggaggaccaggcggagatcagcgggtccagccccatcctctccatcaccatcagcgaggacggctccatgagcatcaagaacgaggaggaggagcagacgctgaccatcctgatccggaccggcctcctggtcatctccgggctgttcccggtgagcatccccatcaccgccgccgcctggtacctctgggaggtgaagaagcagcgcgccggcgtcctgtgggacgtgcccagcccgccgcccgtggggaaggcggagctggaggacggcgcctaccggatcaagcagaaggggatcctcggctacagccagatcggcgccggggtctacaaggagggcaccttccacacgatgtggcacgtgacccgcggggccgtgctgatgcaccggggcaagcgcatcgagccctcctgggccgacgtcaagaaggacctgatcagctacgggggcggctggaagctcgagggggagtggaaggagggcgaggaggtccaggtgctggcgctggagcccgggaagaacccccgggccgtccagaccaagcccggcctcttcaagaccaacacggggaccatcggcgccgtgtccctggacttcagccccggcacctccgggagccccatcgtggaccgcaagggcaaggtcgtggggctgtacggcaacggcgtggtcacccggtccggggcctacgtgagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcggaccctcatcctggcgccgacgcgcgtcgtggccgccgagatggaggaggccctgcgcgggctccccatccggtaccagacccccgccatccgcgcggagcacaccggccgggagatcgtggacctgatgtgccacgccaccttcacgatgcgcctgctctcccccgtccgggtgccgaactacaacctgatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagtccaacgcgcccatcatcgacgaggagcgggagatccccgagcgcagctggaactccggccacgagtgggtcaccgacttcaaggggaagaccgtgtggttcgtgccgagcatcaaggccggcaacgacatcgccgcctgcctgcggaagaacggcaagaaggtcatccagctctcccgcaagaccttcgacagcgagtacgtgaagacgcggaccaacgactgggacttcgtggtcaccaccgacatctccgagatgggggccaacttcaaggcggagcgcgtgatcgacccccggcgctgcatgaagcccgtgatcctgacggacggcgaggagcgggtcatcctggccgggcccatgccggtgacccacagctccgccgcccagcgccggggccgcatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagaccttcgtcgacctgatgcggcgcggggacctgcccgtgtggctcgcctaccgggtggccgcggagggcatcaactacgccgaccgccggtggtgcttcgacggggtcaagaacaaccagatcctggaggagaacgtggaggtggagatctggacgaaggagggcgagcgcaagaagctgaagccgcggtggctcgacgcccgcatctactccgaccccctggccctgaaggagttcaaggagttcgcggccggccggaagtccctcaccctgaacctgatcaccgagatggggcgcctccccaccttcatgacgcagaaggcccgggacgccctggacaacctggccgtcctccacaccgcggaggccggcgggcgcgcctacaaccacgccctgtccgagctgcccgagaccctcgagaccctgctgctcctgacgctgctcgccaccgtgaccggcggcatcttcctgttcctgatgagcgggaagggcgtggggaagatgaccctcggcatgtgctgcatcatcaccgcgtccatcctgctgtggtacgcccagatccagccgcactggatcgccgccagcatcatcctcgagttcttcctgatcgtcctgctcatccccgagcccgagaagcagcggacgccccaggacaaccagctgacctacgtggtcatcgccatcctgaccgtggtggcggccaccatggccaacgagatggggttcctcgagaagacgaagaaggacctgggcctgggcagcatcgccacccaggagccggagtccaacatcctcgacatcgacctgcgccccgccagcgcgtggaccctgtacgccgtcgccaccacgttcgtgacccccatgctccggcactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcacgctgaccgccgccctgctcctgctgatcgcgcactacgccatcatcggccccggcctccaggccaaggccacccgcgaggcccagaagcgggcggccgccgggatcatgaagaaccccaccgtggacggcatcacggtgatcgacctggacccgatcccctacgaccccaagttcgagaagcagctggggcaggtcatgctcctgatcctgtgcgtgacccaggtgctcatgatgcgcaccacctgggccctgtgcgaggccctgacgctcgcgaccggccccatctccaccctgtgggaggggaacccgggccgcttctggaacaccacgatcgccgtcagcatggccaacatcttccggggctcctacctggccggggcgggcctcctgttcagcatcatgaagaacaccaccaacacccgccgggggacgggcaacatcggcgagaccctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtgagccggggctccgccaagctccgctggttcgtcgagcggaacatggtgacgcccgagggcaaggtggtcgacctggggtgcggccgcgggggctggagctactactgcgggggcctgaagaacgtgcgggaggtgaagggcctcaccaagggcggccccgggcacgaggagcccatcccgatgtccacctacggctggaacctggtccgcctgcagagcggggtggacgtgttcttcacgccgcccgagaagtgcgacacgctcctgtgcgacatcggcgagagctcccccaacccgaccatcgaggcgggccggaccctgcgcgtcctcagcctggtggagaactggctgaacaacgacacccagttctgcatcaaggtgctcaacccctacatgccctccgtcatcgagaagatggagaccctgcagcggaagtacgggggcgccctggtgcgcaacccgctgagccggaactccacgcacgagatgtactgggtgagcaacgccaccgggaacatcgtctccagcgtgaacatgatctcccgcatgctcatcaaccggttcaccatgaagcacaagaaggccacctacgagcccgacgtggacctgggcagcgggacgcgcaacatcggcatcgagtccgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcgtccagcatggtcaacggggtggtgcggctcctgaccaagccgtgggacgtcgtgcccatggtgacccagatggccatgaccgacacgacccccttcggccagcagcgcgtcttcaaggagaaggtggacacccggacccaggagcccaaggagggcacgaagaagctgatgaagatcaccgccgagtggctctggaaggagctggggaagaagaagaccccgcgcatgtgcacccgggaggagttcacgcgcaaggtgcggtccaacgccgccctgggcgcgatcttcaccgacgagaacaagtggaagtccgcccgcgaggccgtcgaggactcccggttctgggagctcgtggacaaggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttcagccgcgagaactccctgagcggggtcgagggcgaggggctccacaagctgggctacatcctgcgggacgtgtccaagaaggagggcggggccatgtacgccgacgacaccgcgggctgggacacgcgcatcaccctcgaggacctgaagaacgaggagatggtgaccaaccacatggagggggagcacaagcggctggccgaggccatcttcaagctcacctaccagaacaaggtcgtgcgcgtccagcggcccacgccccgcggcaccgtgatggacatcatcagccggcgcgaccagcgcgggtccggccaggtgggcacctacgggctgaacaccttcacgaacatggaggcccagctgatccggcagatggagggcgaggggatcttcaagagcatccagcacctcaccgtcaccgaggagatcgccgtgcagaactggctggcgcgcgtgggccgggagcgcctgtcccggatggccatcagcggcgacgactgcgtcgtgaagcccctcgacgaccgcttcgcctccgccctgaccgccctgaacgacatggggaaggtgcggaaggacatccagcagtgggagccgagcaagggctggaacgactggacgcaggtccccttctgctcccaccacttccacgagctcatcatgaaggacgggcgcgtgctggtggtcccctgccggaaccaggacgagctgatcggccgcgcgcggatcagccagggggccggctggtccctcaaggagaccgcctgcctgggcaagagctacgcccagatgtggtccctgatgtacttccaccgccgggacctccgcctggccgcgaacgccatctgcagcgccgtgccctcccactgggtgccgaccagccggaccacctggagcatccacgccaagcacgagtggatgacgaccgaggacatgctgaccgtctggaaccgcgtgtggatccaggagaacccctggatggaggacaagacccccgtggagtcctgggaggaggtcccctacctcgggaagcgggaggaccagtggtgcggcagcctgatcgggctgacgtcccgcgcgacctgggccaagaacatccagaccgccatcaaccaggtgcggagcctcatcggcaacgaggagtacaccgactacatgccgtccatgaagcgcttccgccgggaggaggaggaggccggggtgctgtggtga

SEQ ID NO: 9666 - RNA, 9876 nt, synthetic construct
  misc_feature 1..9876: note = derived and/or modified CDS sequence (opt1) from DENV-2__FM210226__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcgccgtgagcttcgtgaccctgatcacggggaacatgtccttccgggacctgggccgcgtcatggtgatggtgggggccgcgatgaccgacgacatcggcatcggcgtcacctacctcgccctgctggccgccttcaaggtgcgccccaccttcgccgcggggctcctgctgcggaagctcacgagcaaggagctgatgatggccaccatcggcatcgccctgctctcccagagcaccatcccggagaccatcctggagctgacggacgccctcgccctggggatgatggtgctgaagatcgtccgcaacatggagaagtaccagctcgcggtgaccatcatggccatctcctgcgtgcccaacgccgtcatcctgcagaacgcctggaaggtgagctgcaccatcctggcgaccgtgtccgtcagccccctcctgctgacgtccagccagcagaaggccgactggatccccctcgccctgaccatcaagggcctgaacccgaccgccatcttcctcaccacgctgtcccggaccagcaagaagcgctcctggcccctgaacgaggccatcatggcggtgggcatggtcagcatcctcgcctccagcctgctgaagaacgacatccccatgaccgggcccctcgtggccggcgggctgctgaccgtgtgctacgtcctcacgggccggagcgccgacctggagctggagcgcgccaccgacgtgaagtgggaggaccaggcggagatctccgggagctccccgatcctcagcatcaccatcgccgaggacggctccatgagcatcaagaacgaggaggaggagcagaccctgacgatcctgatccggaccggcctcctggtgatctccgggctgttccccgtcagcatccccatcaccgccgccgcctggtacctctgggaggtgaagaagcagcgcgcgggcgtgctgtgggacgtcccctccccgccgcccgtggggaaggccgagctggaggacggcgcctaccggatcaagcagaaggggatcctcggctacagccagatcggcgccggggtgtacaaggagggcaccttccacaccatgtggcacgtcacgcgcggggccgtgctgatgcaccggggcaagcgcatcgagccgtcctgggcggacgtgaagaaggacctgatcagctacgggggcggctggaagctcgagggggagtggaaggagggcgaggaggtccaggtgctggccctggagcccgggaagaacccccgggccgtgcagaccaagcccggcctcttcaagaccaacaccgggacgatcggcgccgtctccctggacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctcacgatcatggacctgcaccccggcgccgggaagaccaagcgctacctgccggccatcgtgcgggaggcgatcaagcgcggcctgcggaccctcatcctggcccccacccgcgtggtcgccgccgagatggaggaggccctgcgcgggctccccatccggtaccagacgcccgcgatccgcgccgagcacaccggccgggagatcgtggacctgatgtgccacgccaccttcaccatgcgcctgctcagcccggtgcgggtccccaactacaacctgatcatcatggacgaggcccacttcacggaccccgccagcatcgcggcccgcggctacatctccacccgggtggagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctctcccgcaagaccttcgacagcgagtacgtcaagacccggacgaacgactgggacttcgtggtgaccaccgacatctccgagatgggggcgaacttcaaggccgagcgcgtcatcgacccccggcgctgcatgaagcccgtgatcctgaccgacggcgaggagcgggtgatcctggccgggccgatgcccgtcacgcacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacaccccggagggcatcatccccagcatgttcgagcccgagcgggagaaggtggacgccatcgacggggagtaccgcctccggggcgaggcccgcaagaccttcgtggacctgatgcggcgcggggacctgccggtctggctcgcctaccgggtggcggccgagggcatcaactacgccgaccgccggtggtgcttcgacggggtgaagaacaaccagatcctggaggagaacgtcgaggtggagatctggaccaaggagggcgagcgcaagaagctgaagccccggtggctcgacgcccgcatctactccgaccccctggcgctgaaggagttcaaggagttcgccgccggccgcaagagcctcacgctgaacctgatcaccgagatggggcgcctccccaccttcatgacccagaaggcccgggacgccctggacaacctggcggtgctccacacggccgaggccggcgggcgcgcctacaaccacgccctgtccgagctgccggagaccctcgagaccctgctgctcctgaccctgctcgcgacggtcaccggcggcatcttcctgttcctgatgagcgggaagggcgtggggaagatgaccctcggcatgtgctgcatcatcaccgcctccatcctgctgtggcacgcccagatccagccccactggatcgccgccagcatcatcctcgagttcttcctgatcgtcctgctcatccccgagcccgagaagcagcggaccccgcaggacaaccagctgacgtacgtggtgatcgcgatcctgaccgtcgtggccgccaccatggccaacgagatggggttcctcgagaagaccaagaaggacctgggcctgggctccatcgccacgcaggagcccgagagcaacatcctcgacatcgacctgcgccccgcgagcgcctggaccctgtacgccgtggccaccaccttcgtcacgcccatgctccggcactccatcgagaacagctccgtgaacgtgagcctgaccgcgatcgccaaccaggccaccgtcctgatggggctcggcaaggggtggccgctgtccaagatggacatcggcgtgcccctgctcgccatcgggtgctacagccaggtgaaccccatcaccctgacggccgcgctgctcctgctggtcgcccactacgccatcatcggccccggcctccaggccaaggccacccgcgaggcgcagaagcgggccgccgccgggatcatgaagaacccgaccgtggacggcatcaccgtgatcgacctggaccccatcccctacgaccccaagttcgagaagcagctggggcaggtcatgctcctgatcctgtgcgtgacccaggtgctcatgatgcgcaccacctgggccctgtgcgaggcgctgaccctcgccacgggcccgatctccaccctgtgggaggggaaccccggccgcttctggaacaccaccatcgccgtcagcatggccaacatcttccggggctcctacctggcgggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggccaaggagggcatcaagcgcggggagaccgaccaccacgccgtgagccggggctccgcgaagctccgctggttcgtcgagcggaacatggtgacccccgagggcaaggtggtcgacctggggtgcggccgcgggggctggagctactactgcgggggcctgaagaacgtgcgggaggtgaagggcctcacgaagggcggccccgggcacgaggagccggtccccatgtccacctacggctggaacctggtgcgcctgcagagcggggtggacgtcttcttcacgccgcccgagaagtgcgacaccctcctgtgcgacatcggcgagtccagcccgaaccccacgatcgaggccggccggaccctgcgcgtgctcagcctggtggagaactggctgaacaacgacacccagttctgcatcaaggtcctcaacccctacatgccgtccgtgatcgagaagatggagaccctgcagcggaagtacgggggcgccctggtgcgcaaccccctgagccggaactccacccacgagatgtactgggtcagcaacgccacggggaacatcgtgtccagcgtgaacatgatctcccgcatgctcatcaaccggttcaccatgaagcacaagaaggccacctacgagcccgacgtcgacctgggcagcgggacccgcaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtgaacggggtggtccggctcctgacgaagccctgggacgtggtgcccatggtcacccagatggccatgaccgacaccacgcccttcggccagcagcgcgtgttcaaggagaaggtggacacccggacccaggagccgaaggagggcaccaagaagctgatgaagatcacggccgagtggctctggaaggagctggggaagaagaagacgccccggatgtgcacccgggaggagttcacccgcaaggtccggtccaacgccgcgctgggcgccatcttcacggacgagaacaagtggaagtccgcccgcgaggccgtggaggactcccggttctgggagctcgtggacaaggagcgcaacctgcacctggaggggaagtgcgagacctgcgtctacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgagaacagcctgagcggggtggagggcgaggggctccacaagctgggctacatcctgcgggacgtctccaagaaggagggcggggccatgtacgcggacgacaccgccggctgggacacccgcatcacgctcgaggacctgaagaacgaggagatggtgaccaaccacatggagggggagcacaagaagctggccgaggccatcttcaagctcacctaccagaacaaggtggtccgggtgcagcgccccacgccccggggcacggtgatggacatcatcagccgccgggaccagcgcgggtccggccaggtcggcacctacgggctgaacaccttcaccaacatggaggcccagctgatccgccagatggagggcgaggggatcttcaagagcatccagcacctcacggtgaccgaggagatcgcggtgcagaactggctggcccgggtcggccgcgagcggctgtcccgcatggccatcagcggcgacgactgcgtggtgaagccgctcgacgaccggttcgcctccgccctgaccgcgctgaacgacatggggaaggtccgcaaggacatccagcagtgggagcccagccggggctggaacgactggacccaggtgcccttctgctcccaccacttccacgagctcatcatgaaggacgggcgcgtgctggtcgtgccctgccggaaccaggacgagctgatcggccgcgcccggatcagccagggggccggctggtccctcaaggagacggcctgcctgggcaagagctacgcccagatgtggtccctgatgtacttccaccgccgggacctccgcctggcggccaacgccatctgcagcgccgtgccgtcccactgggtccccaccagccggaccacctggtccatccacgcgaagcacgagtggatgaccacggaggacatgctgaccgtgtggaaccgcgtgtggatccaggagaacccctggatggaggacaagacccccgtcgagagctgggaggaggtgccgtacctcgggaagcgggaggaccagtggtgcggcagcctgatcgggctgacctcccgcgccacgtgggccaagaacatccagaccgccatcaaccaggtgcggagcctcatcggcaacgaggagtacaccgactacatgccctccatgaagcgcttccgccgggaggaggaggaggccggggtcctgtggtga

SEQ ID NO: 9667 - RNA, 9876 nt, synthetic construct
  misc_feature 1..9876: note = derived and/or modified CDS sequence (opt1) from DENV-2__FM210227__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcaccccgcagtccagcgtcaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggcggacacccagggcagcaactggatccagaaggagacgctggtgaccttcaagaacccccacgccaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgcggagacccagcacgggacgatcgtgatccgcgtgcagtacgagggcgacggctccccctgcaagatccccttcgagatcatggacctggagaagcggcacgtcctcgggcgcctgatcaccgtgaacccgatcgtgaccgagaaggacagccccgtcaacatcgaggccgagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtcttcggggccatctacggcgccgccttcagcggggtgtcctggaccatgaagatcctgatcggcgcgatcatcacgtggatcgggatgaacagccgctccaccagcctgtccgtgagcctggtcctcgtgggcgtgatcaccctgtacctgggggccatggtccaggccgactccggctgcgtggtgagctggaagaacaaggagctcaagtgcggctccgggatcttcatcaccgacaacgtccacacgtggaccgagcagtacaagttccagcccgagagccccagcaagctggcctccgccatccagaaggcgcacgaggagggcatctgcgggatccggagcgtgacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgccgagtgcccgaacaccaaccgggcctggaacagcctggaggtcgaggactacggcttcggggtgttcacgaccaacatctggctcaagctgcgcgagaagcaggacgtgttctgcgactccaagctgatgagcgcggccatcaaggacaaccgggccgtccacgccgacatgggctactggatcgagtccaccctcaacgacacctggaagatggagaaggccagcttcatcgaggtgaagtcctgccactggcccaagagccacaccctgtggtccaacggcgtgctggagagcgagatgatcatccccaagtccttcgcggggcccgtcagccagcacaactaccgcccgggctaccacacgcagaccgccgggccctggcacctcggcaagctggagatggacttcgacttctgcgaggggaccaccgtggtggtcacggaggactgcggcaaccggggccccagcctgcgcaccaccaccgcctccgggaagctcatcacggagtggtgctgccggagctgcaccctgcccccgctgcgctaccggggcgaggacgggtgctggtacggcatggagatccgccccctcaaggagaaggaggagaacctggtgaactccctggtgaccgccgggcacggccagatcgacaacttcagcctcggcgtcctggggatggcgctgttcctcgaggagatgctgcggacccgcgtgggcacgaagcacgccatcctgctcgtggccgtctccttcgtgaccctgatcaccgggaacatgagcttccgggacctgggccgcgtgatggtcatggtgggggccaccatgacggacgacatcggcatgggcgtgacctacctcgccctgctggcggccttcaaggtccgccccaccttcgccgccgggctcctgctgcggaagctcacctccaaggagctgatgatggccacgatcggcatcgcgctgctcagccagtccaccatccccgagaccatcctggagctgaccgacgccctcgccctggggatgatgatcctgaagatcgtgcgcaacatggagaagtaccagctcgccgtgacgatcatggccatcagctgcgtcccgaacgcggtgatcctgcagaacgcctggaaggtgtcctgcaccatcctggccgccgtcagcgtgagccccctcctgctgaccagctcccagcagaaggcggactggatccccctcgccctgaccatcaagggcctgaaccccacggccatcttcctcaccaccctgagccggacctccaagaagcgcagctggccgctgaacgaggccatcatggccgtgggcatggtctccatcctcgcgagcagcctgctgaagaacgacatccccatgacggggcccctcgtggccggcgggctgctgaccgtctgctacgtgctcaccggccggtccgccgacctggagctggagcgcgccaccgacgtgaagtgggaggaccaggccgagatcagcgggtccagccccatcctctccatcacgatcagcgaggacggctccatgagcatcaagaacgaggaggaggagcagaccctgaccatcctgatccggaccggcctcctggtcatctccgggctgttcccggtgagcatccccatcaccgcggccgcctggtacctctgggaggtgaagaagcagcgcgccggcgtcctgtgggacgtgcccagcccgccgcccgtggggaaggccgagctggaggacggcgcgtaccggatcaagcagaaggggatcctcggctacagccagatcggcgccggggtctacaaggagggcacgttccacaccatgtggcacgtgacccgcggggccgtgctgatgcaccggggcaagcgcatcgagccctcctgggccgacgtcaagaaggacctgatcagctacgggggcggctggaagctcgagggggagtggaaggagggcgaggaggtccaggtgctggccctggagcccgggaagaacccccgggcggtccagaccaagcccggcctcttcaagacgaacaccgggaccatcggcgccgtgtccctggacttcagccccggcacctccgggagccccatcgtggaccgcaagggcaaggtcgtggggctgtacggcaacggcgtggtcacgcggtccggggcctacgtgagcgccatcgcgcagaccgagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcggacgctcatcctggccccgacccgcgtcgtggcggccgagatggaggaggccctgcgcgggctccccatccggtaccagacccccgccatccgcgccgagcacaccggccgggagatcgtggacctgatgtgccacgcgacgttcaccatgcgcctgctctcccccgtccgggtgccgaactacaacctgatcatcatggacgaggcccacttcaccgaccccgccagcatcgccgcccgcggctacatctccacccgggtggagatgggggaggcggccggcatcttcatgacggccacgccgcccgggagccgcgacccgttcccccagtccaacgcccccatcatggacgaggagcgggagatccccgagcgcagctggaacttcggccacgagtgggtcaccgacttcaaggggaagaccgtgtggttcgtgccgtccatcaaggcgggcaacgacatcgccgcctgcctgcggaagaacggcaagaaggtcatccagctcagccgcaagacgttcgactccgagtacgtgaagacccggaccaacgactgggacttcgtggtcaccacggacatcagcgagatgggggccaacttcaaggccgagcgcgtgatcgacccccggcgctgcatgaagcccgtgatcctgaccgacggcgaggagcgggtcatcctggcggggcccatgccggtgacccactccagcgccgcccagcgccggggccgcatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacggggtcaagaacaaccagatcctggaggagaacgtggaggtggagatctggaccaaggagggcgagcgcaagaagctgaagccgcggtggctcgacgcccgcatctacagcgaccccctggccctgaaggagttcaaggagttcgccgcgggccggaagtccctcaccctgaacctgatcaccgagatggggcgcctccccacgttcatgacccagaaggcccgggacgccctggacaacctggccgtcctccacaccgccgaggcgggcgggcgcgcctacaaccacgccctgagcgagctgcccgagaccctcgagacgctgctgctcctgaccctgctcgccaccgtgaccggcggcatcttcctgttcctgatgtccgggaagggcgtggggaagatgaccctcggcatgtgctgcatcatcacggccagcatcctgctgtggtacgcgcagatccagccgcactggatcgccgcctccatcatcctcgagttcttcctgatcgtcctgctcatccccgagcccgagaagcagcggacgccccaggacaaccagctgacctacgtggtcatcgccatcctgaccgtggtggccgcgacgatggccaacgagatggggttcctcgagaagaccaagaaggacctgggcctgggcagcgtcgccacccaggagccggagagcaacatcctcgacatcgacctgcgccccgcctccgcctggaccctgtacgcggtggccacgaccttcgtgacccccatgctccggcacagcatcgagaactccagcgtcaacgtgtccctgaccgccatcgccaaccaggcgacggtgctgatggggctcggcaaggggtggcccctgagcaagatggacatcggcgtcccgctgctcgccatcgggtgctactcccaggtgaaccccatcaccctgaccgccgccctgctcctgctggtggcccactacgcgatcatcggccccggcctccaggccaaggccacccgcgaggcccagaagcgggccgcggccgggatcatgaagaaccccacggtcgacggcatcaccgtgatcgacctggacccgatcccctacgaccccaagttcgagaagcagctgggccaggtgatgctcctgatcctgtgcgtcacccaggtgctcatgatgcgcaccacgtgggccctgtgcgaggccctgaccctcgccaccggccccatcagcaccctgtgggaggggaacccgggccgcttctggaacacgaccatcgcggtgtccatggccaacatcttccggggcagctacctggccggggccggcctcctgttctccatcatgaagaacaccaccaacacgcgccgggggaccggcaacatcggcgagaccctgggggagaagtggaagtcccgcctcaacgcgctgggcaagtccgagttccagatctacaagaagtccgggatccaggaggtcgaccggaccctggccaaggagggcatcaagcgcggggagacggaccaccacgccgtgtcccggggcagcgccaagctccgctggttcgtggagcggaacatggtcacccccgagggcaaggtggtggacctggggtgcggccgcgggggctggtcctactactgcgggggcctgaagaacgtccgggaggtgaagggcctcaccaagggcgggcccgggcacgaggagcccatcccgatgagcacctacggctggaacctggtgcgcctgcagtccggggtcgacgtgttcttcacgccgcccgagaagtgcgacaccctcctgtgcgacatcggcgagagcagccccaacccgaccatcgaggccggccggaccctgcgcgtgctctccctggtcgagaactggctgaacaacgacacccagttctgcatcaaggtgctcaacccctacatgcccagcgtgatcgagaagatggagacgctgcagcggaagtacgggggcgcgctggtccgcaacccgctgtcccggaacagcacccacgagatgtactgggtgtccaacgccaccgggaacatcgtgagctccgtcaacatgatcagccgcatgctcatcaaccggttcaccatgaagcacaagaaggccacgtacgagcccgacgtggacctgggctccgggacccgcaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtcgtgcggctcctgaccaagccgtgggacgtggtccccatggtgacccagatggcgatgacggacaccacccccttcggccagcagcgcgtgttcaaggagaaggtcgacacccggacgcaggagcccaaggagggcaccaagaagctgatgaagatcaccgccgagtggctctggaaggagctggggaagaagaagaccccgcgcatgtgcacgcgggaggagttcacccgcaaggtgcggagcaacgccgccctgggcgccatcttcaccgacgagaacaagtggaagtccgcgcgcgaggccgtggaggacagccggttctgggagctcgtcgacaaggagcgcaacctgcacctggaggggaagtgcgagacctgcgtgtacaacatgatgggcaagcgggagaagaagctcggggagttcggcaaggccaagggctcccgcgccatctggtacatgtggctgggggcgcggttcctggagttcgaggccctcggcttcctgaacgaggaccactggttcagccgcgagaacagcctgtccggggtggagggcgaggggctccacaagctgggctacatcctgcgggacgtcagcaagaaggagggcggggccatgtacgccgacgacacggccggctgggacacccgcatcaccctcgaggacctgaagaacgaggagatggtgaccaaccacatgggcggcgagcacaagcggctggcggaggccatcttcaagctcacgtaccagaacaaggtcgtgcgcgtgcagcggcccacgccccgcgggaccgtcatggacatcatctcccggcgcgaccagcgcggcagcggccaggtggggacctacggcctgaacacgttcaccaacatggaggcccagctgatccggcagatggagggggagggcatcttcaagtccatccagcacctcaccgtgaccgaggagatcgccgtccagaactggctggcccgcgtgggccgggagcgcctgagccggatggcgatctccggggacgactgcgtggtcaagcccctcgacgaccgcttcgccagcgccctgacggccctgaacgacatgggcaaggtgcggaaggacatccagcagtgggagccgtccaaggggtggaacgactggacccaggtgcccttctgcagccaccacttccacgacctcatcatgaaggacggccgcgtcctggtggtgccctgccggaaccaggacgagctgatcgggcgcgcccggatctcccagggcgcgggctggagcctcaaggagaccgcctgcctggggaagtcctacgcccagatgtggagcctgatgtacttccaccgccgggacctccgcctggccgccaacgcgatctgctccgccgtccccagccactgggtgccgacctcccggaccacgtggagcatccacgccaagcacgagtggatgaccaccgaggacatgctgaccgtgtggaaccgcgtctggatccaggagaacccctggatggaggacaagacgcccgtggagagctgggaggaggtgccctacctcggcaagcgggaggaccagtggtgcgggtccctgatcggcctgaccagccgcgccacctgggcgaagaacatccagaccgccatcaaccaggtccggtccctcatcgggaacgaggagtacacggactacatgccgagcatgaagcgcttccgccgggaggaggaggaggccggcgtgctgtggtga

SEQ ID NO: 9668 - RNA, 9876 nt, synthetic construct
  misc_feature 1..9876: note = derived and/or modified CDS sequence (opt1) from DENV-2__FM210204__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacacgatcacctacaagtgccccctcctgcggcagaacgagcccgaggacatcgactgctggtgcaactccacctccacctgggtgacgtacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacgtggatcctgcggcaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggcgaagctgacgaacaccaccaccgagtcccggtgccccacgcagggcgagcccagcctgaacgaggagcaggacaagcgcttcgtctgcaagcactccatggtggaccggggctgggggaacggctgcgggctgttcggcaagggcgggatcgtgacctgcgccatgttcacgtgcaagaagaacatggagggcaagatcgtccagcccgagaacctggagtacaccatcgtgatcacgccccacagcggggaggagcacgccgtgggcaacgacaccgggaagcacggcaaggagatcaagatcacgccccagtccagcgtcaccgaggccgagctgaccgggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggcggacacccagggcagcaactggatccagaaggagacgctggtgaccttcaagaacccccacgccaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgcggagacccagcacgggacgatcgtgatccgcgtgcagtacgagggcgacggctccccctgcaagatccccttcgagatcatggacctggagaagcggcacgtcctcgggcgcctgatcaccgtgaacccgatcgtgaccgagaaggacagccccgtcaacatcgaggccgagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggcgctccaccaggtcttcggggccatctacggcgccgccttcagcggggtgtcctggaccatgaagatcctgatcggcgcgatcatcacgtggatcgggatgaacagccgctccaccagcctgtccgtgagcctggtcctcgtgggcgtgatcaccctgtacctgggggccatggtccaggccgactccggctgcgtggtgagctggaagaacaaggagctcaagtgcggctccgggatcttcatcaccgacaacgtccacacgtggaccgagcagtacaagttccagcccgagagccccagcaagctggcctccgccatccagaaggcgtacgaggagggcatctgcgggatccggagcgtgacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggctggagaccgccgagtgccccaacaccaaccgggcctggaacagcctcgaggtcgaggactacggcttcggggtgttcacgaccaacatctggctgaagctgcgcgagaagcaggacgtgttctgcgactccaagctcatgagcgcggccatcaaggacaaccgggccgtccacgccgacatgggctactggatcgagtccgccctgaacgacacctggaagatggagaaggcgagcttcatcgaggtgaagtcctgccactggcccaagagccacaccctgtggtccaacggcgtgctcgagagcgagatgatcatccccaagtccttcgccgggcccgtcagccagcacaactaccgccccggctaccacacccagacggccgggccgtggcacctgggcaagctggagatggacttcgacttctgcgaggggaccaccgtggtggtcaccgaggactgcggcaaccggggccccagcctccgcacgaccaccgcctccgggaagctgatcaccgagtggtgctgccggagctgcacgctgccgcccctccgctaccggggcgaggacgggtgctggtacggcatggagatccgcccgctgaaggagaaggaggagaacctggtgaactccctcgtgaccgcggggcacggccagatcgacaacttcagcctgggcgtcctggggatggccctcttcctggaggagatgctgcggacccgcgtgggcaccaagcacgccatcctcctggtggccgtctccttcgtgacgctgatcaccgggaacatgagcttcaaggacctcggccgggtgatggtcatggtgggggccaccatgaccgacgacatcggcatgggcgtgacgtacctggcgctgctcgccgccttcaaggtccgccccaccttcgccgccgggctgctgctccgcaagctgacctccaaggagctgatgatggcgaccatcggcatcgccctcctgagccagtccacgatccccgagaccatcctggagctcaccgacgccctggccctggggatgatggtgctcaagatcgtgcggaacatggagaagtaccagctggccgtcaccatcatggcgatcagctgcgtgcccaacgccgtgatcctgcagaacgcctggaaggtctcctgcacgatcctcgccgcggtgagcgtgtccccgctgctgctcaccagctcccagcagaaggccgactggatccccctggccctgaccatcaagggcctcaaccccaccgccatcttcctgacgaccctgagccgcacctccaagaagcggagctggcccctcaacgaggccatcatggcggtcggcatggtgtccatcctggccagcagcctgctcaagaacgacatcccgatgaccgggcccctggtcgccggcgggctgctcacggtgtgctacgtgctgaccggccgctccgccgacctggagctcgagcgggccaccgacgtcaagtgggaggaccaggcggagatcagcgggtccagccccatcctgtccatcaccatcagcgaggacggctccatgagcatcaagaacgaggaggaggagcagacgctgaccatcctcatccgcaccggcctgctggtgatctccggcctcttccccgtgagcatcccgatcaccgccgccgcctggtacctgtgggaggtcaagaagcagcgggccggcgtgctgtgggacgtgcccagcccgccgcccgtcgggaaggcggagctcgaggacggcgcctaccgcatcaagcagaaggggatcctgggctacagccagatcggcgccggggtgtacaaggagggcaccttccacacgatgtggcacgtgacccgcggggccgtcctgatgcaccgcggcaagcggatcgagccctcctgggccgacgtgaagaaggacctcatcagctacgggggcggctggaagctggagggggagtggaaggagggcgaggaggtgcaggtcctggcgctcgagcccgggaagaacccgcgcgccgtgcagaccaagcccggcctgttcaagaccaacacggggaccatcggcgccgtgtccctggacttcagccccggcacctccgggagccccatcgtcgaccggaagggcaaggtggtggggctctacggcaacggcgtcgtgacccgctccggggcctacgtgagcgcgatcgcccagacggagaagtccatcgaggacaacccggagatcgaggacgacatcttccggaagaagcgcctgaccatcatggacctgcaccccggcgccgggaagaccaagcggtacctgcccgccatcgtccgcgaggccatcaagcggggcctccgcaccctgatcctggcgcccacgcgggtggtggccgccgagatggaggaggccctccgcgggctgccgatccgctaccagacccccgccatccgggcggagcacaccggccgcgagatcgtcgacctgatgtgccacgccaccttcacgatgcggctcctgagccccgtgcgcgtgcccaactacaacctgatcatcatggacgaggcccacttcaccgacccggccagcatcgccgcgcggggctacatctccacccgcgtcgagatgggggaggccgccggcatcttcatgaccgccacgccgcccgggagccgggaccccttcccgcagtccaacgcgcccatcatggacgaggagcgcgagatccccgagcggagctggaactccggccacgagtgggtgaccgacttcaaggggaagaccgtgtggttcgtccccagcatcaaggccggcaacgacatcgccgcctgcctccgcaagaacggcaagaaggtgatccagctgtcccggaagaccttcgacagcgagtacgtgaagacgcgcaccaacgactgggacttcgtcgtgaccaccgacatctccgagatgggggccaacttcaaggcggagcgggtgatcgacccgcgccggtgcatgaagcccgtcatcctgacggacggcgaggagcgcgtgatcctcgccgggcccatgcccgtgacccacagctccgccgcccagcggcgcggccggatcgggcgcaacccgaagaacgagaacgaccagtacatctacatgggcgagcccctggagaacgacgaggactgcgcccactggaaggaggcgaagatgctgctcgacaacatcaacacccccgagggcatcatccccagcatgttcgagccggagcgcgagaaggtcgacgccatcgacggggagtaccggctgcgcggcgaggcccggaagaccttcgtggacctgatgcgccgcggggacctccccgtgtggctggcctaccgcgtcgccgcggagggcatcaactacgccgaccggcgctggtgcttcgacggggtgaagaacaaccagatcctggaggagaacgtggaggtcgagatctggacgaaggagggcgagcggaagaagctcaagccccgctggctggacgcccggatctactccgacccgctggccctcaaggagttcaaggagttcgcggccggccgcaagagcctgaccctgaacctcatcaccgagatggggcggctgcccaccttcatgacgcagaaggcccgcgacgccctggacaacctcgccgtgctgcacaccgcggaggccggcgggcgggcctacaaccacgccctgtccgagctccccgagaccctggagaccctgctcctgctgacgctcctggccaccgtgaccggcggcatcttcctgttcctcatgagcgggaagggcgtcgggaagatgaccctgggcatgtgctgcatcatcaccgcgtccatcctgctctggtacgcccagatccagccccactggatcgccgccagcatcatcctggagttcttcctgatcgtgctcctgatcccggagcccgagaagcagcgcacgccccaggacaaccagctgacctacgtcgtgatcgccatcctcaccgtggtcgcggccaccatggccaacgagatggggttcctggagaagacgaagaaggacctgggcctcggcagcgtggccacccaggagcccgagtccaacatcctggacatcgacctgcggccggccagcgcgtggaccctctacgccgtggccaccacgttcgtcacccccatgctgcgccactccatcgagaacagctccgtgaacgtgagcctgaccgccatcgcgaaccaggccaccgtcctcatggggctgggcaaggggtggcccctgtccaagatggacatcggcgtgcccctcctggccatcgggtgctacagccaggtgaacccgatcacgctgaccgccgccctcctgctgctcgtcgcgcactacgccatcatcggccccggcctgcaggccaaggccacccgggaggcccagaagcgcgcggccgccgggatcatgaagaaccccaccgtggacggcatcacggtgatcgacctggaccccatcccgtacgaccccaagttcgagaagcagctcgggcaggtcatgctgctgatcctctgcgtgacccaggtgctgatgatgcggaccacctgggccctgtgcgaggccctcacgctggcgaccggccccatctccaccctgtgggaggggaaccccggccgcttctggaacaccacgatcgccgtcagcatggccaacatcttccgcggctcctacctcgccggggcgggcctgctgttcagcatcatgaagaacaccaccaacacccggcgcgggacgggcaacatcggcgagaccctcggggagaagtggaagtcccggctgaacgccctgggcaagagcgagttccagatctacaagaagtccgggatccaggaggtggaccgcaccctcgccaaggagggcatcaagcgcggggagaccgaccaccacgccgtgagccgcggctccgccaagctgcggtggttcgtcgagcgcaacatggtgacgccggagggcaaggtggtcgacctggggtgcggccgcgggggctggagctactactgcgggggcctcaagaacgtgcgcgaggtgaagggcctgaccaagggcggccccgggcacgaggagcccatccccatgtccacctacggctggaacctggtccggctccagagcggggtggacgtgttcttcaccccgcccgagaagtgcgacacgctgctgtgcgacatcggcgagagctcccccaaccccaccatcgaggcgggccgcaccctccgggtcctgagcctggtggagaactggctcaacaacgacacccagttctgcatcaaggtgctgaacccgtacatgccgcccgtcatcgagaagatggagaccctgcagcgcaagtacgggggcgccctggtgcggaacccgctctcccgcaacagcacgcacgagatgtactgggtgtccaacgccaccgggaacatcgtcagctccgtgaacatgatcagccggatgctgatcaaccgcttcaccatgaagcacaagaaggccacctacgagcccgacgtggacctgggctccgggacgcggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagaccaagcagacgggctccgcgagctccatggtcaacggggtggtgcgcctgctgaccaagccgtgggacgtcgtgcccatggtgacccagatggccatgaccgacacgacccccttcggccagcagcgggtcttcaaggagaaggtggacacccgcacccaggagcccaaggagggcacgaagaagctcatgaagatcaccgccgagtggctgtggaaggagctggggaagaagaagaccccgcggatgtgcacccgcgaggagttcacgcggaaggtgcgcagcaacgccgccctcggcgcgatcttcaccgacgagaacaagtggaagtccgcccgggaggccgtcgaggacagccgcttctgggagctggtggacaaggagcggaacctgcacctcgaggggaagtgcgagacctgcgtgtacaacatgatgggcaagcgcgagaagaagctgggggagttcggcaaggccaagggctcccgggcgatctggtacatgtggctgggggcccgcttcctcgagttcgaggccctgggcttcctgaacgaggaccactggttcagccgggagaacagcctctccggggtcgagggcgaggggctgcacaagctgggctacatcctccgcgacgtgagcaagaaggagggcggggccatgtacgccgacgacaccgcgggctgggacacgcggatcaccctggaggacctgaagaacgaggagatggtcaccaaccacatggagggggagcacaagcgcctcgccgaggccatcttcaagctgacctaccagaacaaggtggtgcgggtccagcgccccacgccccggggcaccgtgatggacatcatctcccgccgggaccagcgcgggagcggccaggtgggcacctacgggctgaacaccttcacgaacatggaggcccagctcatccgccagatggagggcgaggggatcttcaagtccatccagcacctgaccgtcaccgaggagatcgccgtgcagaactggctggcgcgggtgggccgcgagcggctcagccgcatggccatctccggcgacgactgcgtcgtgaagcccctggacgaccggttcgccagcgccctgaccgccctcaacgacatggggaaggtgcgcaaggacatccagcagtgggagccgtccaagggctggaacgactggacgcaggtccccttctgcagccaccacttccacgacctgatcatgaaggacgggcgggtgctggtggtcccctgccgcaaccaggacgagctcatcggccgggcgcgcatctcccagggggccggctggagcctgaaggagaccgcctgcctgggcaagtcctacgcccagatgtggagcctcatgtacttccaccggcgcgacctgcggctggccgcgaacgccatctgctccgccgtgcccagccactgggtgccgacctcccgcaccacctggagcatccacgccaagcacgagtggatgacgaccgaggacatgctcaccgtctggaaccgggtgtggatccaggagaacccctggatggaggacaagacccccgtggagagctgggaggaggtcccctacctggggaagcgcgaggaccagtggtgcggctccctgatcgggctcacgagccgggcgacctgggccaagaacatccagaccgccatcaaccaggtgcgctccctgatcggcaacgaggagtacaccgactacatgccgagcatgaagcggttccgccgcgaggaggaggaggccggggtgctgtggtga

SEQ ID NO: 9669 - RNA, 9876 nt, synthetic construct
  misc_feature 1..9876: note = derived and/or modified CDS sequence (opt1) from DENV-2__FM210230__SS-prME
  source 1..9876: mol_type = other RNA
accgccggggtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccacccgggcttcaccatcatggcggccatcctggcctacaccgtcgggaccacccacttccagcgggccctcatcttcatcctgctggcggccgtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccaccctggacttcgagctgatcaagaccgaggccaagcagcccgcgaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcgggctgttcggcaagggcgggatcgtcacgtgcgccatgttcacgtgcaagaagaacatggagggcaagatcgtgcagcccgagaacctggagtacaccatcgtgatcacgccccacagcggggaggagcacgccgtcggcaacgacacggggaagcacggcaaggagatcaagatcaccccgcagtcccccatcaccgaggccgagctgaccgggtacggcaccgtgacgatggagtgcagcccccgcaccggcctcgacttcaacgagatggtgctgctgcagatggaggacaaggcgtggctcgtccaccggcagtggttcctggacctgcccctcccgtggctgcccggggccgacacccagggctccaactggatccagaaggagaccctggtgacgttcaagaacccccacgccaagaagcaggacgtggtcgtgctcgggagccaggagggcgccatgcacaccgccctgaccggggcgaccgagatccagatgtccagcggcaacctcctgttcacgggccacctgaagtgccgcctgcggatggacaagctccagctgaaggggatgagctactccatgtgcaccggcaagttcaagatcgtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggccgagcccccgttcggcgacagctacatcatcatcggggtggagcccggccagctgaagctcaactggttcaagaaggggtccagcatcggccagatgttcgagaccaccatgcgcggcgccaagcggatggccatcctgggggacacggcgtgggacttcggctccctcggcggggtgttcaccagcatcgggaaggccctccaccaggtcttcggggccatctacggcgccgcgttctccggggtgagctggaccatgaagatcctgatcggcgtgatcatcacctggatcgggatgaactcccgcagcacgtccctgagcgtctccctggtgctcgtgggcgtcatcaccctgtacctgggggccatggtgcaggccgacagcggctgcgtggtctcctggaagaacaaggagctcaagtgcggcagcgggatcttcatcaccgacaacgtgcacacctggacggagcagtacaagttccagcccgagtcccccagcaagctggccagcgccatccagaaggcgcacgaggagggcatctgcgggatccggtccgtgacccgcctggagaacctcatgtggaagcagatcaccccggagctgaaccacatcctgagcgagaacgaggtcaagctcaccatcatgacgggcgacatcaaggggatcatgcaggccggcaagcggtccctgcgcccccagcccaccgagctgaagtacagctggaagacctggggcaaggccaagatgctctccaccgagagccacaaccagacgttcctgatcgacgggccggagaccgccgagtgccccaacaccaaccgggcctggaactccctggaggtggaggactacggcttcggggtgttcaccacgaacatctggctcaagctgcgcgagaagcaggacgtcttctgcgacagcaagctgatgtccgcggccatcaaggacaaccgggccgtgcacgccgacatgggctactggatcgagagcgccctcaacgacacctggaagatggagaaggcgtccttcatcgaggtcaagagctgccactggcccaagtcccacaccctgtggagcaacggcgtgctggagtccgagatgatcatccccaagagcttcgccgggccggtgtcccagcacaactaccgccccggctactacacccagaccgccgggccctggcacctcggcaagctggagatggacttcgacttctgcgaggggacgaccgtggtcgtgaccgaggactgcggcaaccggggccccagcctgcgcaccacgaccgccagcgggaagctcatcaccgagtggtgctgccggtcctgcaccctgccgcccctgcgctaccggggcgaggacgggtgctggtacggcatggagatccgccccctcaaggagaaggaggagaacctggtgaacagcctggtcacggcggggcacggccagatcgacaacttctccctcggcgtgctggggatggccctgttcctcgaggagatgctgcggacccgcgtgggcaccaagcacgccatcctgctcgtcaccgtgagcttcgtgacgctgatcaccgggaacatgtccttccgggacctgggccgcgtcatggtgatggtgggggccgccatgaccgacgacatcggcatgggcgtcacctacctcgcgctgctggccgccttcaaggtgcgccccacgttcgccgccgggctcctgctgcggaagctcaccagcaaggagctgatgatggcgaccatcggcatcgccctgctctcccagagcaccatcccggagacgatcctggagctgaccgacgccctcgccctggggatgatggtgctgaagatcgtccgcaacatggagaagtaccagctcgccgtgaccatcatggcgatctcctgcgtgcccaacgccgtcatcctgcagaacgcctggaaggtgagctgcaccatcctggccgcggtgtccgtcagccccatgctcctgacgtccagccagcagaaggccgactggatccccctggccctcaccatcaagggcctgaacccgaccgccatcttcctgaccacgctctcccggaccagcaagaagcgctcctggcccctgaacgaggccatcatggcggtgggcatggtcagcatcctggcctccagcctcctgaagaacgacatccccatgaccgggcccctggtggccggcgggctcctgaccgtgtgctacgtcctgacgggccggagcgccgacctcgagctggagcgcgccaccgacgtgaagtgggaggaccaggcggagatctccgggagctccccgatcctgagcatcaccatcgccgaggacggctccatgagcatcaagaacgaggaggaggagcagaccctcacgatcctgatccggaccggcctgctcgtgatctccgggctgttccccgtcagcatccccatcaccgccgccgcctggtacctgtgggaggtgaagaagcagcgcgcgggcgtgctctgggacgtcccctccccgccgcccgtggggaaggccgagctggaggacggcgcctaccggatcaagcagaaggggatcctgggctacagccagatcggcgccggggtgtacaaggagggcaccttccacaccatgtggcacgtcacgcgcggggccgtgctcatgcaccggggcaagcgcatcgagccgtcctgggcggacgtgaagaaggacctgatcagctacgggggcggctggaagctggagggggagtggaaggagggcgaggaggtccaggtgctcgccctggagcccgggaagaacccccgggccgtgcagaccaagcccggcctgttcaagaccaacaccgggacgatcggcgccgtctccctcgacttcagcccgggcacctccgggagccccatcgtggaccgcaagggcaaggtggtcgggctgtacggcaacggcgtggtgacccggtccggggcgtacgtcagcgccatcgcccagaccgagaagtccatcgaggacaaccccgagatcgaggacgacatcttccgcaagaagcggctgacgatcatggacctccaccccggcgccgggaagaccaagcgctacctgccggccatcgtgcgggaggcgatcaagcgcggcctgcggaccctgatcctcgcccccacccgcgtggtcgccgccgagatggaggaggccctgcgcgggctgcccatccggtaccagacgcccgcgatccgcgccgagcacaccggccgggagatcgtggacctcatgtgccacgccaccttcaccatgcgcctgctgagcccggtgcgggtccccaactacaacctcatcatcatggacgaggcccacttcacggaccccgccagcatcgcggcccgcggctacatctccacccgggtggagatgggggaggccgccggcatcttcatgaccgcgacgccgcccgggagccgcgaccccttcccccagtccaacgcccccatcatggacgaggagcgggagatccccgagcgcagctggaactccggccacgagtgggtgacggacttcaaggggaagaccgtctggttcgtgcccagcatcaaggccggcaacgacatcgccgcctgcctgcggaagaacggcaagaaggtgatccagctgtcccgcaagaccttcgacagcgagtacgtcaagacccggacgaacgactgggacttcgtggtgaccaccgacatctccgagatgggggcgaacttcaaggccgagcgcgtcatcgacccccggcgctgcatgaagcccgtgatcctcaccgacggcgaggagcgggtgatcctggccgggccgatgcccgtcacgcacagctccgccgcccagcgccggggccgcatcgggcgcaaccccaagaacgagaacgaccagtacatctacatgggcgagcccctggagaacgacgaggactgcgcgcactggaaggaggccaagatgctcctggacaacatcaacaccccggagggcatcatccccagcatgttcgagcccgagcgggagaaggtggacgccatcgacggggagtaccgcctgcggggcgaggcccgcaagaccttcgtggacctcatgcggcgcggggacctgccggtctggctggcctaccgggtggcggccgagggcatcaactacgccgaccgccggtggtgcttcgacggggtgaagaacaaccagatcctcgaggagaacgtcgaggtggagatctggaccaaggagggcgagcgcaagaagctgaagccccggtggctggacgcccgcatctactccgaccccctcgcgctgaaggagttcaaggagttcgccgccggccgcaagagcctgacgctcaacctgatcaccgagatggggcgcctgcccaccttcatgacccagaaggcccgggacgccctcgacaacctggcggtgctgcacacggccgaggccggcgggcgcgcctacaaccacgccctctccgagctgccggagaccctggagaccctcctgctgctcaccctgctggcgacggtcaccggcggcatcttcctcttcctgatgagcgggaagggcgtggggaagatgaccctgggcatgtgctgcatcatcaccgcctccatcctcctgtggtacgcccagatccagccccactggatcgccgccagcatcatcctggagttcttcctcatcgtcctgctgatccccgagcccgagaagcagcggaccccgcaggacaaccagctcacgtacgtggtgatcgcgatcctgaccgtcgtggccgccaccatggccaacgagatggggttcctggagaagaccaagaaggacctcggcctgggctccatcgccacgcaggagcccgagagcaacatcctggacatcgacctccgccccgcgagcgcctggaccctgtacgccgtggccaccaccttcgtcacgcccatgctgcggcactccatcgagaacagctccgtgaacgtgagcctcaccgcgatcgccaaccaggccaccgtcctgatggggctgggcaaggggtggccgctctccaagatggacatcggcgtgcccctgctggccatcgggtgctacagccaggtgaaccccatcaccctcacggccgcgctgctgctcctggtcgcccactacgccatcatcggccccggcctgcaggccaaggccacccgcgaggcgcagaagcgggccgccgccgggatcatgaagaacccgaccgtggacggcgtgaccgtcatcgacctcgaccccatcccctacgaccccaagttcgagaagcagctgggccaggtgatgctgctcatcctgtgcgtgacgcaggtcctgatgatgcgcaccacctgggccctctgcgaggcgctgaccctggccacgggcccgatctccaccctctgggaggggaaccccggccgcttctggaacaccaccatcgccgtgagcatggccaacatcttccggggctcctacctggcgggggccggcctcctgttcagcatcatgaagaacacgaccaacacccgccgggggaccggcaacatcggcgagacgctgggggagaagtggaagtcccgcctgaacgccctcggcaagagcgagttccagatctacaagaagtccgggatccaggaggtggaccggaccctggccaaggagggcatcaagcgcggggagaccgaccaccacgccgtcagccggggctccgcgaagctgcgctggttcgtggagcggaacatggtgacccccgagggcaaggtcgtggacctcgggtgcggccgcgggggctggagctactactgcgggggcctgaaggacgtgcgggaggtcaagggcctgacgaagggcgggcccgggcacgaggagccgatccccatgtccacctacggctggaacctcgtgcgcctgcagagcggggtggacgtcttcttcacgccgcccgagaagtgcgacaccctgctctgcgacatcggcgagtccagcccgaaccccacgatcgaggccggccggaccctgcgcgtgctgagcctcgtggagaactggctgaacaacgacacccagttctgcatcaaggtcctgaacccctacatgccgtccgtgatcgagaagatggagaccctccagcggaagtacgggggcgccctggtgcgcaaccccctgagccggaactccacccacgagatgtactgggtcagcaacgccacggggaacatcgtgtccagcgtgaacatgatctcccgcatgctgatcaaccggttcaccatgaagcacaagaaggccacctacgagcccgacgtcgacctcggcagcgggacccgcaacatcggcatcgagtccgagatccccaacctggacatcatcggcaagcgcatcgagaagatcaagcaggagcacgagacgagctggcactacgaccaggaccacccgtacaagacctgggcgtaccacgggtcctacgagaccaagcagaccggcagcgcctccagcatggtgaacggggtggtccggctgctcacgaagccctgggacgtggtgcccatggtcacccagatggccatgaccgacaccacgcccttcggccagcagcgcgtgttcaaggagaaggtggacacccggacccaggagccgaaggagggcaccaagaagctgatgaagatcacggccgagtggctgtggaaggagctcgggaagaagaagacgccccggatctgcacccgggaggagttcacccgcaaggtccggtccaacgccgcgctgggcgccatcttcacggacgagaacaagtggaagtccgcccgcgaggccgtggaggactcccggttctgggagctggtggacaaggagcgcaacctccacctggaggggaagtgcgagacctgcgtctacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaagggcgggggcgccatgtacgcggacgacaccgccgggtgggacacccgcatcacgctggaggacctcaagaacgaggagatggtgaccaaccacatggagggcgagcacaagaagctggccgaggccatcttcaagctgacctaccagaacaaggtggtccgggtgcagcgccccacgccccgggggacggtgatggacatcatcagccgccgggaccagcgcggctccggccaggtcgggacctacggcctcaacaccttcaccaacatggaggcccagctgatccgccagatggagggggagggcgtgttcaagagcatccagcggctgacggtgaccgaggagatcgcggtccagaactggctcgcccgcgtgggccgggagcgcctgtcccggatggccatcagcggggacgactgcgtggtcaagccgctggacgaccgcttcgcctccgccctcaccgcgctgaacgacatgggcaaggtgcggaaggacatccagcagtgggagcccagccgcgggtggaacgactggacccaggtgcccttctgctcccaccacttccacgagctgatcatgaaggacggccgggtcctcgtggtgccctgccgcaaccaggacgagctgatcgggcgggcccgcatcagccagggcgccggctggtccctgaaggagacggcctgcctcggcaagagctacgcccagatgtggtccctgatgtacttccaccggcgcgacctgcggctcgcggccaacgccatctgcagcgccgtcccgtcccactgggtgcccaccagccgcaccacctggtccatccacgcgaagcacgagtggatgaccacggaggacatgctgaccgtgtggaaccgggtctggatccaggagaacccctggatggaggacaagacccccgtggagagctgggaggaggtgccgtacctgggcaagcgcgaggaccagtggtgcgggagcctcatcggcctgacctcccgggccacgtgggccaagaacatccagaccgccatcaaccaggtccgcagcctgatcgggaacgaggagtacaccgactacatgccctccatgaagcgcttccggcgcgaggaggaggaggccggcgtgctctggtga

SEQ ID NO: 9670 - RNA, 9876 nt, synthetic construct
  misc_feature 1..9876: note = derived and/or modified CDS sequence (opt1) from DENV-2__KC762665__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggccctgcaccaggtcttcggggcgatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggccgactccgggtgcgtggtcagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacgccaaccgggcctggaactccctggaggtggaggactacgggttcggcgtgttcaccacgaacatctggctcaagctgaaggagcgccaggacgccttctgcgacagcaagctgatgtccgccgcgatcaaggacaaccgggccgtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtggtggtcaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgacggccggccacgggcagatcgacaacttcagcctcggcgtcctgggcatggcgctgttcctcgaggagatgctgcgcacccgggtggggaccaagcacgccatcctgctcgtggccgtctccttcgtgaccctgatcacgggcaacatgagcttccgcgacctggggcgcgtgatggtcatggtgggcgccaccatgaccgacgacatcgggatgggcgtgacctacctcgccctgctggcggccttcaaggtccggcccacgttcgccgccggcctcctgctgcgcaagctcacctccaaggagctgatgatgaccaccatcgggatcacgctgctcagccagtccaccatccccgagaccatcctggagctgaccgacgccctcgcgctgggcatgatggtgctgaagatcgtgcggaacatggagaagtaccagctcgccgtcacgatcatggccatcctgtgcgtgccgaacgccgtcatcctgcagaacgcctggaaggtgagctgcaccaccctcgcggtggtctccgtgagccccctgctgctcacctccagccagcagaaggccgactggatccccctggccctgacgatcaaggggctcaaccccaccgccatcttcctgaccaccctgtcccgcacgagcaagaagcggtcctggccgctcaacgaggcgatcatggccgtgggcatggtcagcatcctggcctccagcctgctcaagaacgacatccccatgaccggccccctggtggccgggggcctgctcaccgtgtgctacgtcctgaccgggcgcagcgccgacctggagctcgagcgggcggccgacgtgcgctgggaggagcaggccgagatctccggcagctcccccatcctgagcatcacgatctccgaggacgggagcatgtccatcaagaacgaggaggaggagcagaccctgaccatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggacgttccacaccatgtggcacgtcacccgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagacgagcaccggcaccatcggggccgtctccctggacttcagccccggcacctccggcagccccatcgtggacaagaaggggaaggtggtcggcctctacgggaacggcgtggtgacgcggtccggcacctacgtcagcgcgatcgcccagaccgagaagtccatcgaggacaaccccgagatcgaggacgacatcttccgcaagaagcggctgaccatcatggacctgcaccccggggccggcaagacgaagcgctacctgcccgccatcgtgcgggaggcgatcaagcgcgggctccggaccctgatcctggccccgacccgcgtggtcgccgccgagatggaggaggccctccgcggcctgcccatccggtaccagacccccgcgatccgcgccgagcacacggggcgggagatcgtggacctgatgtgccacgccaccttcaccatgcgcctcctgtcccccatccgggtgccgaactacaacctgatcatcatggacgaggcccacttcaccgaccccgccagcatcgcggcccgcggctacatctccacgcgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagacggtgtggttcgtcccgagcatcaaggccgggaacgacatcgccgcctgcctccggaagaacggcaagaaggtgatccagctgtcccgcaagaccttcgacttcgagtacatcaagacccggaccaacgactgggacttcgtggtcacgaccgacatcagcgagatgggcgcgaacttcaaggccgagcgcgtgatcgacccccggcgctgcatgaagcccgtgatcctgaccgacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacgcccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcctaccgggtcgcggccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgaccctgaacctcatcacggagatgggccgcctgcccaccttcatgacccagaaggcccggaacgccctggacaacctcgcggtgctgcacaccgccgaggccgggggccgcgcctacaaccacgccctgagcgagctccccgagacgctggagaccctgctcctgctgaccctcctggcgaccgtcaccgggggcatcttcctgttcctcatgtccggcaaggggatcggcaagatgacgctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcacggtggtggccgccaccatggccaacgagatgggcttcctggagaagaccaagaaggacttcgggctgggcagcatcaccacgcagcagccggagagcaacatcctcgacatcgacctgcgccccgcctccgcgtggaccctgtacgccgtcgccaccaccttcatcacgcccatgctccggcacagcatcgagaactccagcgtgaacgtgtccctgaccgccatcgccaaccaggcgaccgtcctgatgggcctcgggaagggctggcccctgagcaagatggacatcggggtgccgctgctcgccatcggctgctactcccaggtgaaccccatcaccctgacggccgccctgctcctgctggtcgcgcactacgccatcatcgggcccggcctccaggccaaggccacccgcgaggcccagaagcgggcggccgccggcatcatgaagaaccccaccgtggacgggatcaccgtgatcgacctggacccgatcccctacgaccccaagttcgagaagcagctgggccaggtcatgctcctggtgctgtgcgtgacgcaggtcctcatgatgcgcaccacctgggccctgtgcgaggccctgaccctcgcgacggggcccatcagcaccctgtgggagggcaacccggggcgcttctggaacaccaccatcgccgtgtccatggccaacatcttccggggcagctacctggccggcgccgggctcctgttctccatcatgaagaacacggcgaacacccgccggggcaccgggaacaccggcgagacgctgggcgagaagtggaagaaccgcctcaacgccctgggcaagagcgagttccagatctacaagaagtccggcatccaggaggtggaccggaccctggccaaggaggggatcaagcgcggcgagaccgaccaccacgccgtcagccgggggtccgcgaagctccgctggttcgtggagcggaacctggtggcccccgagggcaaggtcgtggacctgggctgcgggcgcggcgggtggagctactactgcggcgggctcaagaacgtgaaggaggtcaagggcctgaccaagggcgggcccggccacgaggagcccatcccgatgtccacgtacgggtggaacctggtgcggctccagagcggcgtggacgtcttcttcacgccgcccgagaagtgcgacaccctgctgtgcgacatcggggagtccagccccaacccgaccgtggaggccggccgcaccctccgggtgctgaacctggtcgagaactggctcaacaacaacacgcagttctgcatcaaggtgctgaacccctacatgcccagcgtgatcgagaagatggaggccctgcagcgcaagtacggcggggccctggtccggaacccgctctcccgcaacagcacccacgagatgtactgggtgtccaacgcgagcggcaacatcgtgtccagcgtcaacatgatctcccggatgctgatcaaccgcttcaccatgcggcacaagaaggccacctacgagcccgacgtggacctggggagcggcacgcgcaacatcgggatcgagtccgagacccccaacctcgacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcggctgctgaccaagccgtgggacgtgatccccatggtcacccagatggccatgacggacaccacccccttcgggcagcagcgcgtgttcaaggagaaggtggacacccggacgcaggagcccaaggagggcaccaagaagctcatgaagatcaccgcggagtggctgtggaaggagctgggcaagaagaagaccccgcgcatgtgcacgcgggaggagttcacccgcaaggtccggtccaacgccgccctcggggccatcttcaccgacgagaacaagtggaagtccgcccgcgaggcggtggaggactccggcttctgggagctggtcgacaaggagcggaacctgcacctcgaggggaagtgcgagacctgcgtgtacaacatgatgggcaagcgcgagaagaagctgggggagttcggcaaggccaagggcagccgggccatctggtacatgtggctgggggcccgcttcctcgagttcgaggcgctgggcttcctgaacgaggaccactggttctcccgggagaacagcctcagcggggtggagggcgaggggctgcacaagctgggctacatcctccgcgacgtctccaagaaggagggcggggccatgtacgccgacgacacggccggctgggacacccggatcaccctggaggacctgaagaacgaggagatggtgaccaaccacatggagggggagcacaagaagctcgccgaggcgatcttcaagctgacgtaccagaacaaggtggtccgcgtgcagcggcccacgccccggggcaccgtgatggacatcatcagccggcgcgaccagcgggggtccggccaggtcgtgacctacggcctgaacacgttcaccaacatggaggcccagctcatccgccagatggagggggagggcgtgttcaagagcatccagcagctgaccgtcaccgaggagatcgccgtgaagaactggctggtgcgcgtcgggcgggagcgcctctcccggatggccatcagcggcgacgactgcgtggtgaagcccctggacgaccgcttcgcctccgcgctgacggccctcaacgacatgggcaaggtccggaaggacatccagcagtgggagccgagccgcgggtggaacgactggacccaggtgcccttctgctcccaccacttccacgagctgatcatgaaggacggccgggtgctggtcgtgccctgccgcaaccaggacgagctcatcgggcgggcccgcatcagccagggcgccgggtggtccctgcgggagaccgcctgcctgggcaagagctacgcgcagatgtggtccctcatgtacttccaccgccgggacctgcgcctggccgccaacgccatctgcagcgccgtgccctcccactgggtcccgaccagccggaccacgtggtccatccacgcgacccacgagtggatgaccaccgaggacatgctcacggtgtggaaccgcgtgtggatccaggagaacccctggatggaggacaagacccccgtcgagagctgggaggagatcccctacctgggcaagcgggaggaccagtggtgcgggagcctgatcggcctcacctcccgcgccacctgggccaagaacatccagacggccatcaaccaggtgcggagcctgatcgggaacgaggagtacaccgactacatgccgtccatgaagcgcttccgccgggaggaggaggaggcgggcgtgctgtggtga

SEQ ID NO: 9671 - RNA, 9876 nt, synthetic construct
  misc_feature 1..9876: note = derived and/or modified CDS sequence (opt1) from DENV-2__KC762669__SS-prME
  source 1..9876: mol_type = other RNA
accgccggcatcatcatcatggtgatccccaccgtcatggccttccacctgaccacccgcaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtcacctacgggacctgcaccgccaccggcgagcaccggcgcgagaagcggagcgtggccctggtgccccacgtcggcatggggctggagacccgcaccgagacctggatgtccagcgagggcgcctggaagcacgcccagcggatcgagacctgggtgctccgccacccggggttcaccatcatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgtccgagaacgaggtgaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtcttcaccaccaacatctggctcaagctgaaggagcgccaggacgtgttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcaccacggtcgtggtgaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgaccgccggccacgggcagatcgacaacttcagcctcggcgtgctgggcatggcgctgttcctcgaggagatgctgcgcacgcgggtcgggaccaagcacgccatcctgctcgtggccgtgtccttcgtcaccctgatcaccggcaacatgagcttccgcgacctggggcgcgtgatggtgatggtcggcgccacgatgaccgacgacatcgggatgggcgtgacctacctcgccctgctggcggccttcaaggtgcggcccaccttcgccgccggcctcctgctgcgcaagctcacgtccaaggagctgatgatgaccaccatcgggatcgtcctgctcagccagtccaccatccccgagacgatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcatcatcggggccgtcagcctggacttctcccccggcacgagcggctcccccatcgtggacaagaaggggaaggtggtcggcctctacgggaacggcgtggtgacccggagcggcacctacgtctccgcgatcgcccagaccgagaagtccatcgaggacaaccccgagatcgaggacgacatcttccgcaagaagcggctgacgatcatggacctgcaccccggggccggcaagaccaagcgctacctgcccgccatcgtgcgggaggcgatcaagcgcgggctccggaccctgatcctggccccgacccgcgtggtcgccgccgagatggaggaggccctccgcggcctgcccatccggtaccagacgcccgcgatccgcgccgagcacaccgggcgggagatcgtggacctgatgtgccacgccaccttcaccatgcgcctcctgagccccatccgggtgccgaactacaacctgatcatcatggacgaggcccacttcacggaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgacggacttcaagggcaagaccgtgtggttcgtcccgtccatcaaggccgggaacgacatcgccgcctgcctccggaagaacggcaagaaggtgatccagctgagccgcaagaccttcgacttcgagtacatcaagacccggacgaacgactgggacttcgtggtcaccaccgacatctccgagatgggcgcgaacttcaaggccgagcgcgtgatcgacccccggcgctgcatgaagcccgtgatcctgaccgacggggaggagcgggtcatcctcgccggccccatgccggtgacgcacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctactccgaccccctggccctcaaggagttcaaggagttcgcggccggccgcaagagcctgacgctgaacctcatcaccgagatgggccgcctgcccaccttcatgacccagaaggcccggaacgccctggacaacctcgcggtgctgcacacggccgaggccgggggccgcgcctacaaccacgccctgtccgagctccccgagaccctggagaccctgctcctgctgaccctcctggcgacggtcaccgggggcatcttcctgttcctcatgagcggcaaggggatcggcaagatgaccctggggatgtgctgcatcatcaccgcctccatcctgctctggtacgcccagatccagccgcactggatcgccgccagcatcatcctggagttcttcctgatcgtgctcctgatccccgagcccgagaagcagcggacgccccaggacaaccagctgacgtacgtggtcatcgcgatcctcaccgtggtggccgccaccatggccaacgagatgggcttcctggagaagaccaagaaggacttcgggctgggctccatcacgacccagcagctcgagagcaacatcctggacatcgacctgcgcccggccagcgcgtggaccctctacgccgtcgccaccacgttcatcacccccatgctgcggcactccatcgagaacagctccgtgaacgtgagcctgaccgccatcgccaaccaggcgaccgtcctcatgggcctggggaagggctggcccctgtccaagatggacatcggggtgcccctcctggccatcggctgctacagccaggtgaacccgatcacgctgaccgccgccctcctgctgctcgtcgcgcactacgccatcatcgggcccggcctgcaggccaaggccacccgcgaggcccagaagcgggcggccgccggcatcatgaagaaccccaccgtggacgggatcacggtgatcgacctggaccccatcccgtacgaccccaagttcgagaagcagctcggccaggtcatgctgctggtgctctgcgtgacccaggtcctgatgatgcgcaccacctgggccctgtgcgaggccctcacgctggcgaccgggcccatctccaccctgtgggagggcaaccccgggcgcttctggaacaccacgatcgccgtgagcatggccaacatcttccggggctcctacctcgccggcgccgggctgctgttcagcatcatgaagaacaccgcgaacacccgccggggcaccgggaacacgggcgagaccctcggcgagaagtggaagaaccgcctgaacgccctggggaagtccgagttccagatctacaagaagtccggcatccaggaggtggaccggaccctcgccaaggaggggatcaagcgcggcgagaccgaccaccacgccgtctcccgggggagcgcgaagctgcgctggttcgtggagcggaacctggtgacgccggagggcaaggtcgtggacctcggctgcgggcgcggcgggtggtcctactactgcggcgggctgaagaacgtgaaggaggtcaagggcctgaccaagggcgggcccggccacgaggagcccatccccatgagcacctacgggtggaacctcgtgcggctgcagtccggcgtggacgtcttcttcaccccgcccgagaagtgcgacacgctgctctgcgacatcggggagagctcccccaaccccaccgtggaggccggccgcaccctgcgggtgctgaacctcgtcgagaactggctgaacaacaacacccagttctgcatcaaggtgctgaacccgtacatgcccagcgtgatcgagaagatggaggccctgcagcgcaagtacggcggggccctcgtccggaaccccctgagccgcaactccacccacgagatgtactgggtgagcaacgcctccggcaacatcgtgagctccgtcaacatgatcagccggatgctgatcaaccgcttcacgatgcggcacaagaaggcgacctacgagccggacgtggacctcgggtccggcacccgcaacatcgggatcgagagcgagacccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtcgtgcggctgctcacgaagccctgggacgtgatcccgatggtcacccagatggccatgaccgacaccacgcccttcgggcagcagcgcgtgttcaaggagaaggtcgacacccggacccaggagcccaaggagggcaccaagaagctgatgaagatcacggccgagtggctgtggaaggagctcggcaagaagaagacgccccggatgtgcacccgggaggagttcacccgcaaggtgcggagcaacgcggccctgggggccatcttcacggacgagaacaagtggaagtccgcccgcgaggccgtggaggacagcggcttctgggagctggtcgacaaggagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaactccctgagcggggtggagggcgaggggctgcacaagctcggctacatcctgcgcgacgtcagcaagaaggagggcggggcgatgtacgccgacgacaccgccggctgggacacccggatcacgctggaggacctcaagaacgaggagatggtgaccaaccacatggagggggagcacaagcgcctggccgaggccatcttccggctgacctaccagaacaaggtggtccgcgtgcagcggccgacgccccggggcacggtgatggacatcatctcccggcgcgaccagcgcgggagcggccaggtcgtgacctacggcctcaacaccttcaccaacatggaggcgcagctgatccggcagatggagggggagggcgtgttcaagtccatccagcacctgacggtcaccgaggagatcgccgtgaagaactggctcgcccgcgtggggcgggagcgcctgagccggatggccatctccggcgacgactgcgtcgtgaagcccctggacgaccgcttcgccagcgcgctcaccgccctgaacgacatgggcaaggtgcggaaggacatccagcagtgggagccctcccgcgggtggaacgactggacccaggtcccgttctgcagccaccacttccacgagctgatcatgaaggacggccgggtgctcgtggtcccctgccgcaaccaggacgagctgatcgggcgggcccgcatctcccagggcgccgggtggagcctgcgggagacggcctgcctcggcaagtcctacgcgcagatgtggagcctgatgtacttccaccgccgggacctgcgcctcgccgccaacgccatctgctccgccgtgcccagccactgggtgcccacctcccggaccacctggagcatccacgcgacccacgagtggatgacgaccgaggacatgctgaccgtctggaaccgcgtgtggatccaggagaacccgtggatggaggacaagacccccgtggagtcctgggaggagatcccctacctgggcaagcgggaggaccagtggtgcgggagcctcatcggcctgacgagccgcgccacctgggccaagaacatccagaccgccatcaaccaggtccgctccctgatcgggaacgaggagtacaccgactacatgcccagcatgaagcggttccgccgggaggaggaggaggcgggcgtgctctggtga

SEQ ID NO: 9672 - RNA, 9876 nt, synthetic construct
  misc_feature 1..9876: note = derived and/or modified CDS sequence (opt1) from DENV-2__KC762658__SS-prME
  source 1..9876: mol_type = other RNA
accgccggcatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgcccccggcgagcaccggcgcgagaagcggagcgtcgccctggtgccgcacgtgggcatggggctggagacccgcaccgagacctggatgtccagcgagggcgccgggaagcacgcccagcggatcgagacctgggtcctccgccaccccggcttcaccatcatggcggccatcctggcctacaccatcgggaccacctacttccagcgggtgctgatcttcatcctcctgaccgccgtgaccccctccatgaccatgcgctgcatcggcatcagcaaccgggacttcgtcgagggcgtgtccgggggcagctgggtggacatcgtcctggagcacgggtcctgcgtgaccaccatggcgaagaacaagcccacgctcgacttcgagctgatcaagaccgaggccaagctgccggccaccctccgcaagtactgcatcgaggccaagctgaccaacacgaccaccgccagccggtgccccacccagggcgagccctccctgaacgaggagcaggacaagcgcttcgtgtgcaagcacagcatggtcgaccggggctgggggaacggctgcgggctgttcggcaagggcgggatcgtgacgtgcgcgatgttcacgtgcaagaagaacatggagggcaagatcgtgcagcccgagaacctggagtacaccatcgtcatcaccccgcactccggggaggagaacgccgtgggcaacgacacggggaagcacggcaaggagatcaaggtgacgccccagagctccatcaccgaggccgagctgaccgggtacggcaccgtcacgatggagtgcagcccccgcaccggcctcgacttcaacgagatggtgctgctgcagatggagaacaaggcctggctcgtgcaccggcagtggttcctggacctgcccctcccgtggctgcccggggccgacacccagggctccaactggatccagaaggagaccctggtcacgttcaagaacccccacgcgaagaagcaggacgtggtcgtgctcgggagccaggagggcgccatgcacaccgccctgaccggggccaccgagatccagatgagctccggcaacctcctgttcacgggccacctgaagtgccgcctgcggatggacaagctccagctgaaggggatgagctactccatgtgcaccggcaagttcaaggtggtcaaggagatcgccgagacccagcacgggaccatcgtgatccgcgtgcagtacgagggcgacggcagcccctgcaagatcccgttcgagatcatggacctggagaagcggcacgtcctcgggcgcctgatcacggtgaaccccatcgtgaccgagaaggactcccccgtcaacatcgaggcggagcccccgttcggcgacagctacatcatcatcggggtggagcccggccagctgaagctctcctggttcaagaaggggagctccatcggccagatgttcgagaccaccatgcgcggcgccaagcggatggccatcctgggggacacggcctgggacttcggcagcctcggcggggtgttcacctccatcgggaaggccctccaccaggtcttcggggcgatctacggcgccgccttcagcggggtgtcctggaccatgaagatcctgatcggcgtggtcatcacctggatcgggatgaacagccgctccacgagcctgtccgtgagcctggtgctcgtcggcgtggtgaccctgtacctgggggtcatggtgcaggccgactccggctgcgtggtcagctggaagaacaaggagctcaagtgcggcagcgggatcttcatcaccgacaacgtgcacacctggacggagcagtacaagttccagcccgagtcccccagcaagctggcgtccgccatccagaaggcccacgaggagggcatctgcgggatccggagcgtgacccgcctggagaacctcatgtggaagcagatcaccccggagctgaaccacatcctgtccgagaacgaggtcaagctcaccatcatgacgggcgacatcaaggggatcatgcaggccggcaagcggagcctgcgcccccagcccaccgagctgaagtactcctggaagacctggggcaaggccaagatgctcagcaccgagctgcacaaccacacgttcctgatcgacgggccggagaccgcggagtgccccaacaccaaccgggcctggaactccctcgaggtggaggactacggcttcggggtgttcaccacgaacatctggctgaagctgaaggagcgccaggacgtcttctgcgacagcaagctcatgtccgccgccatcaaggacaaccgggccgtgcacgcggacatgggctactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccgggccggtgagccagcacaactaccgccccggctaccacacccagaccgccgggccctggcacctgggccggctggagatggacttcgacttctgcgaggggacgaccgtggtcgtgaccgaggactgcggcaaccgcggccccagcctccggaccacgaccgcgtccgggaagctgatcaccgagtggtgctgccgcagctgcaccctgccgcccctccggtaccgcggcgaggacgggtgctggtacggcatggagatccggcccctgaaggagaaggaggagaacctggtgaactccctcgtcacggccgggcacggccagatcgacaacttcagcctgggcgtgctggggatggccctcttcctggaggagatgctgcgcacccgggtgggcaccaagcacgccatcctcctggtcgcggtgtccttcgtgaccctgatcacggggaacatgagcttccgcgacctcggccgcgtcatggtgatggtgggggccaccatgaccgacgacatcggcatgggcgtcacctacctggccctgctcgccgccttcaaggtgcggcccacgttcgcggccgggctgctgctccgcaagctgacctccaaggagctgatgatgaccaccatcggcatcgtgctcctgagccagtccacgatcccggagaccatcctggagctcaccgacgccctggccctggggatgatggtcctcaagatcgtgcggaacatggagaagtaccagctggccgtcaccatcatggcgatcctgtgcgtgcccaacgccgtgatcctccagaacgcctggaaggtcagctgcacgaccctggccgtggtgtccgtcagccccctgctcctgacctccagccagcagaaggccgactggatccccctggcgctcaccatcaagggcctgaacccgacggccatcttcctgaccaccctctcccgcaccagcaagaagcggtcctggcccctgaacgaggccatcatggccgtgggcatggtgagcatcctggcgtccagcctcctgaagaacgacatccccatgacggggcccctggtcgccggcgggctcctgaccgtgtgctacgtgctgaccggccgcagcgccgacctcgagctggagcgggccgccgacgtccgctgggaggagcaggcggagatctccgggagctccccgatcctgagcatcaccatctccgaggacggcagcatgtccatcaagaacgaggaggaggagcagacgctcaccatcctgatccggaccggcctgctcgtgatcagcgggctgttccccgtgtccatccccatcaccgccgccgcctggtacctgtgggaggtcaagaagcagcgcgccggcgtgctctgggacgtgcccagcccgccgcccgtcgggaaggcggagctggaggacggcgcctaccggatcaagcagaaggggatcctgggctactcccagatcggcgccggggtgtacaaggagggcaccttccacacgatgtggcacgtgacccgcggggccgtcctcatgcacaagggcaagcggatcgagccgagctgggccgacgtgaagaaggacctgatctcctacgggggcggctggaagctggagggggagtggaaggagggcgaggaggtgcaggtcctcgcgctggagcccgggaagaacccccgcgccgtgcagaccaagcccggcctgttcaagaccaacacggggaccatcggcgccgtgagcctcgacttctccccgggcaccagcgggtcccccatcgtcgacaagaagggcaaggtggtggggctgtacggcaacggcgtcgtgacccggagcgggacgtacgtgtccgccatcgcccagaccgagaagtccatcgaggacaaccccgagatcgaggacgacatcttccgcaagaagcggctgaccatcatggacctgcaccccggcgcggggaagaccaagcgctacctcccggccatcgtccgggaggccatcaagcgcggcctgcggacgctgatcctcgcccccacccgcgtggtggcggccgagatggaggaggccctgcgcgggctgcccatccggtaccagacccccgccatccgcgccgagcacaccggccgggagatcgtcgacctcatgtgccacgcgacgttcaccatgcgcctgctgagcccgatccgggtgcccaactacaacctcatcatcatggacgaggcccacttcaccgaccccgcctccatcgccgcccgcggctacatcagcacccgggtggagatgggggaggcggccggcatcttcatgacggccacgccgcccgggtcccgcgaccccttcccccagagcaacgcccccatcatggacgaggagcgggagatccccgagcgctcctggaacagcggccacgagtgggtcaccgacttcaaggggaagaccgtgtggttcgtgccctccatcaaggccggcaacgacatcgcggcctgcctgcggaagaacggcaagaaggtcatccagctgagccgcaagacgttcgacttcgagtacatcaagacccggaccaacgactgggacttcgtggtgaccacggacatctccgagatgggggccaacttcaaggccgagcgcgtcatcgacccccggcgctgcatgaagcccgtgatcctcaccgacggcgaggagcgggtgatcctggcggggccgatgcccgtcacccacagctccgccgcccagcgccggggccgcgtggggcgcaaccccaagaacgagaacgaccagtacatctacatgggcgagcccctggagaacgacgaggactgcgcccactggaaggaggccaagatgctcctggacaacatcaacaccccggagggcatcatccccagcatgttcgagcccgagcgggagaaggtggacgcgatcgacggggagtaccgcctgcggggcgaggcccgcaagacgttcgtcgagctcatgcggcgcggggacctgccggtgtggctggcctaccgggtcgccgccgagggcatcaactacgcggaccgccggtggtgcttcgacggggtgaagaacaaccagatcctcgaggagaacgtggaggtcgagatctggaccaaggagggcgagcgcaagaagctgaagccccggtggctggacgcccgcatctactccgaccccctcgccctgaaggagttcaaggagttcgccgccggccgcaagagcctgaccctcaacctgatcaccgagatggggcgcctgcccacgttcatgacccagaaggcgcggaacgccctcgacaacctggccgtgctgcacaccgccgaggcgggcgggcgcgcctacaaccacgccctctccgagctgccggagaccctggagacgctcctgctgctcaccctgctggccaccgtgaccggcggcatcttcctcttcctgatgagcgggaagggcatcgggaagatgaccctgggcatgtgctgcatcatcacggcctccatcctcctgtggtacgcgcagatccagccccactggatcgccgccagcatcatcctggagttcttcctcatcgtcctgctgatccccgagcccgagaagcagcggaccccgcaggacaaccagctcacctacgtggtgatcgccatcctgaccgtcgtggccgcgacgatggccaacgagatggggttcctggagaagaccaagaaggacttcggcctcggctccatcaccacccagcagcccgagagcaacatcctggacatcgacctgcgccccgccagcgcctggacgctctacgccgtggcgaccaccttcatcacccccatgctgcggcactccatcgagaacagctccgtcaacgtgagcctgacggccatcgccaaccaggccaccgtgctcatggggctgggcaaggggtggccgctgtccaagatggacatcggcgtccccctcctggccatcgggtgctacagccaggtgaaccccatcaccctgaccgcggccctcctgctgctcgtggcccactacgccatcatcggccccggcctgcaggcgaaggccacgcgcgaggcccagaagcgggccgccgcggggatcatgaagaacccgaccgtcgacggcatcaccgtgatcgacctggaccccatcccctacgaccccaagttcgagaagcagctcggccaggtgatgctgctggtcctctgcgtgacccaggtgctgatgatgcgcacgacctgggccctgtgcgaggccctcaccctggccaccggcccgatctccacgctgtgggaggggaaccccggccgcttctggaacaccaccatcgccgtcagcatggcgaacatcttccggggctcctacctcgccggggccggcctgctgttcagcatcatgaagaacaccgccaacacgcgccgggggaccggcaacaccggcgagaccctcggggagaagtggaagaaccgcctgaacgccctgggcaagtccgagttccagatctacaagaagtccgggatccaggaggtggaccggacgctcgcgaaggagggcatcaagcgcggggagaccgaccaccacgccgtgtcccggggcagcgccaagctgcgctggttcgtcgagcggaacctggtgacccccgagggcaaggtggtcgacctcgggtgcggccgcgggggctggtcctactactgcgggggcctgaagaacgtgaaggaggtgaagggcctgaccaagggcgggcccgggcacgaggagccgatccccatgagcacgtacggctggaacctcgtccggctgcagtccggggtggacgtgttcttcacgccgcccgagaagtgcgacaccctgctctgcgacatcggcgagagctccccgaaccccaccgtcgaggccggccgcaccctgcgggtgctgaacctcgtggagaactggctgaacaacaacacgcagttctgcatcaaggtcctgaacccctacatgccgagcgtgatcgagaagatggaggcgctgcagcgcaagtacgggggcgccctcgtgcggaaccccctgagccgcaactccacccacgagatgtactgggtcagcaacgcctccgggaacatcgtgagctccgtgaacatgatcagccggatgctgatcaaccgcttcaccatgcggcacaagaaggccacctacgagcccgacgtcgacctcggctccgggacgcgcaacatcggcatcgagagcgagacccccaacctggacatcatcggcaagcgcatcgagaagatcaagcaggagcacgagacctcctggcactacgaccaggaccacccgtacaagacctgggcctaccacgggagctacgagacgaagcagaccggctccgcgagctccatggtgaacggggtggtccggctgctcaccaagccctgggacgtgatccccatggtgacccagatggccatgacggacaccacccccttcggccagcagcgcgtcttcaaggagaaggtggacacccggacgcaggagccgaaggagggcaccaagaagctgatgaagatcaccgccgagtggctgtggaaggagctcgggaagaagaagacgccccggatgtgcacgcgggaggagttcacccgcaaggtccggagcaacgccgccctgggcgcgatcttcaccgacgagaacaagtggaagtccgcccgcgaggccgtggaggacagcgggttctgggagctggtggacaaggagcggaacctccacctggagggcaagtgcgagacctgcgtctacaacatgatggggaagcgcgagaagaagctgggcgagttcggcaaggccaaggggtcccgggccatctggtacatgtggctcggcgcgcgcttcctggagttcgaggccctggggttcctcaacgaggaccactggttcagccgggagaactccctgagcggcgtggagggggagggcctgcacaagctcggctacatcctgcgcgacgtgagcaagaaggagggcggggccatgtacgccgacgacacggcggggtgggacacccggatcaccctggaggacctcaagaacgaggagatggtcaccaaccacatggagggcgagcacaagaagctggccgaggccatcttcaagctgacgtaccagaacaaggtggtgcgcgtccagcggcccacgccccgcgggaccgtgatggacatcatctcccggcgcgaccagcggggcagcggccaggtggtcacctacgggctcaacacgttcaccaacatggaggcccagctgatccgccagatggagggcgagggggtgttcaagtccatccagcagctgaccgtgaccgaggagatcgccgtcaagaactggctcgtgcgcgtgggccgggagcgcctgagccggatggcgatctccggcgacgactgcgtcgtgaagccgctggacgaccgcttcgccagcgccctcacggccctgaacgacatggggaaggtgcggaaggacatccagcagtgggagccctcccgcggctggaacgactggacccaggtccccttctgcagccaccacttccacgagctgatcatgaaggacgggcgggtgctcgtggtcccctgccgcaaccaggacgagctgatcggccgggcccgcatctcccagggggcgggctggagcctgcgggagaccgcctgcctcggcaagtcctacgcccagatgtggagcctgatgtacttccaccgccgggacctgcgcctcgccgccaacgcgatctgctccgccgtgccgagccactgggtgcccacctcccggaccacgtggagcatccacgccacccacgagtggatgaccaccgaggacatgctgacggtctggaaccgcgtgtggatccaggagaacccctggatggaggacaagacccccgtggagtcctgggaggagatcccgtacctggggaagcgggaggaccagtggtgcggcagcctcatcgggctgaccagccgcgccacctgggccaagaacatccagacggcgatcaaccaggtccggtccctgatcggcaacgagaagtacaccgactacatgcccagcatgaagcgcttccgccgggaggaggaggaggccggggtgctctggtga

SEQ ID NO: 9673 - RNA, 9876 nt, synthetic construct
  misc_feature 1..9876: note = derived and/or modified CDS sequence (opt1) from DENV-2__KC762660__SS-prME
  source 1..9876: mol_type = other RNA
accgcgggcatcatcatcatgatgatccccaccgtgatggccttccacctgacgacccggaacggggagccccacatgatcgtcagccggcaggagaagggcaagagcctcctgttcaagaccgagaacggggtgaacatgtgcaccctgatggcgatggacctcggcgagctgtgcgaggacacgatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaaggtggtccagcccgagaacctcgagtacaccatcgtgatcacgccccactccggcgaggagaacgccgtggggaacgacaccggcaagcacgggaaggagatcaaggtcaccccgcagagctccatcaccgaggccgagctgaccggctacgggacggtgaccatggagtgcagcccccgcaccggcctggacttcaacgagatggtgctcctgcagatggagaacaaggcctggctggtccaccggcagtggttcctcgacctgcccctgccctggctcccgggcgccgacacccaggggtccaactggatccagaaggagacgctggtgaccttcaagaacccccacgcgaagaagcaggacgtcgtggtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtcgtgaaggagatcgccgagacccagcacggcacgatcgtgatccgcgtccagtacgagggggacggcagcccctgcaagatccccttcgagatcatggacctggagaagcggcacgtgctgggccgcctcatcaccgtgaacccgatcgtcaccgagaaggactcccccgtgaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtcttcacctccatcggcaaggccctgcaccaggtgttcggggcgatctacggcgccgccttcagcggcgtgtcctggaccatgaagatcctcatcggggtcgtgatcacgtggatcggcatgaacagccgctccaccagcctgtccgtgagcctggtcctggtgggggtggtcaccctctacctgggcgtgatggtgcaggccgactccgggtgcgtcgtgagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtcacccgcctggagaacctgatgtggaagcagatcacccccgagctcaaccacatcctgtccgagaacgaggtgaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacaccaaccgggcctggaactccctggaggtggaggactacgggttcggcgtcttcacgaccaacatctggctcaagctgaaggagcgccaggacgtgttctgcgacagcaagctgatgtccgccgccatcaaggacaaccgggccgtgcacgcggacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagacggccggcccctggcacctcgggcggctggagatggacttcgacttctgcgagggcaccaccgtcgtggtgaccgaggactgcgggaaccgcggccccagcctgcggacgaccaccgcgtccggcaagctcatcaccgagtggtgctgccgcagctgcacgctgcccccgctgcggtaccgcggggaggacggctgctggtacgggatggagatccggcccctcaaggagaaggaggagaacctggtcaactccctggtgaccgccggccacgggcagatcgacaacttcagcctcggcgtgctgggcatggccctgttcctcgaggagatgctgcgcacccgggtcgggaccaagcacgccatcctgctcgtggcggtgtccttcgtcacgctgatcaccggcaacatgagcttccgcgacctggggcgcgtgatggtgatggtcggcgccaccatgaccgacgacatcgggatgggcgtgacgtacctcgccctgctggccgccttcaaggtgcggcccaccttcgcggccggcctcctgctgcgcaagctcacctccaaggagctgatgatgaccacgatcgggatcgtcctgctcagccagtccaccatccccgagagcatcctggagctgaccgacgccctcgccctgggcatgatggtgctgaagatcgtccggaacatggagaagtaccagctcgccgtgaccatcatggcgatcctgtgcgtgccgaacgccgtcatcctgcagaacgcctggaaggtgtcctgcacgaccctcgccgtggtcagcgtgagccccctgctgctcaccagctcccagcagaaggccgactggatccccctggcgctgaccatcaaggggctcaaccccacggccatcttcctgaccaccctgagccgcacctccaagaagcggagctggccgctcaacgaggccatcatggccgtgggcatggtctccatcctggcgagcagcctgctcaagaacgacatccccatgacgggccccctggtggccgggggcctgctcaccgtgtgctacgtcctgaccgggcgctccgccgacctggagctcgagcgggccgccgacgtgcgctgggaggagcaggcggagatcagcggctccagccccatcctgtccatcaccatcagcgaggacgggtccatgagcatcaagaacgaggaggaggagcagacgctgaccatcctcatccggaccggcctgctggtgatctccggcctcttcccggtcagcatccccatcaccgccgccgcctggtacctgtgggaggtgaagaagcagcgcgccggggtgctgtgggacgtccccagcccgccgcccgtgggcaaggcggagctcgaggacggggcctaccggatcaagcagaagggcatcctggggtacagccagatcggcgccggcgtgtacaaggaggggaccttccacacgatgtggcacgtcacccgcggcgccgtgctgatgcacaaggggaagcggatcgagccctcctgggccgacgtgaagaaggacctcatcagctacggcgggggctggaagctggagggcgagtggaaggagggggaggaggtccaggtgctggcgctcgagcccggcaagaacccccgcgccgtgcagaccaagcccgggctgttcaagaccaacacgggcaccatcggggccgtctccctggacttcagccccggcacctccggcagccccatcgtggacaagaaggggaaggtggtcggcctctacgggaacggcgtggtgacccggtccggcacgtacgtcagcgccatcgcccagaccgagaagtccatcgaggacaaccccgagatcgaggacgacatcttccgcaagaagcggctgaccatcatggacctgcaccccggggcgggcaagaccaagcgctacctgcccgccatcgtgcgggaggccatcaagcgcgggctccggacgctgatcctggccccgacccgcgtggtcgcggccgagatggaggaggccctccgcggcctgcccatccggtaccagacccccgccatccgcgccgagcacaccgggcgggagatcgtggacctgatgtgccacgcgacgttcaccatgcgcctcctgtcccccatccgggtgccgaactacaacctgatcatcatggacgaggcccacttcatcgaccccgccagcatcgccgcccgcggctacatctccacccgggtcgagatgggcgaggcggccgggatcttcatgaccgccacgccgcccggcagccgcgacccgttcccccagtccaacgcccccatcatggacgaggagcgggagatccccgagcgcagctggaactccgggcacgagtgggtgaccgacttcaagggcaagaccgtgtggttcgtcccgagcatcaaggccgggaacgacatcgcggcctgcctccggaagaacggcaagaaggtgatccagctgtcccgcaagaccttcgacttcgagtacatcaagacgcggaccaacgactgggacttcgtggtcaccaccgacatcagcgagatgggcgccaacttcaaggccgagcgcgtgatcgacccccggcgctgcatgaagcccgtgatcctgacggacggggaggagcgggtcatcctcgcgggccccatgccggtgacccactccagcgccgcccagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtcgacgcgatcgacggcgagtaccgcctgcgcggggaggcccgcaagaccttcgtggacctgatgcggcgcggcgacctccccgtctggctggcctaccgggtggccgccgaggggatcaactacgcggaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgccgccggccggaagtccctgaccctgaacctcatcaccgagatgggccgcctgcccaccttcatgacgcagaaggcgaagaacgccctggacaacctcgccgtgctgcacaccgccgaggccgggggccgggcctacaaccacgccctgagcgagctccccgagaccctggagaccctgctcctgctgacgctcctggccaccgtcaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggccgcgaccatggccaacgagatgggcttcctggagaagacgaagaaggacttcgggctgggcagcatcaccacccagcagccggagagcaacatcctcgacatcgacctgcggcccgcctccgcctggaccctgtacgccgtcgcgacgaccttcatcacccccatgctccgccacagcatcgagaactccagcgtgaacgtgtccctgaccgccatcgccaaccaggccacggtcctgatgggcctcgggaagggctggcccctgagcaagatggacatcggggtgccgctgctcgccatcggctgctactcccaggtgaaccccatcaccctgaccgcggccctgctcctgctggtcgcccactacgccatcatcgggcccggcctccaggcgaaggccacccgggaggcccagaagcgcgccgccgcgggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgccaccgggcccatcagcaccctgtgggagggcaacccggggcgcttctggaacacgaccatcgccgtgtccatggcgaacatcttccgcggcagctacctggccggcgccgggctcctgttctccatcatgaagaacaccgccaacacccggcgcggcacggggaacaccggcgagaccctgggcgagaagtggaagaaccggctcaacgccctggggaagtccgagttccagatctacaagaagtccggcatccaggaggtggaccgcaccctggcgaaggaggggatcaagcggggcgagacggaccaccacgccgtcagccgcgggtccgccaagctccggtggttcgtggagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacccagttctgcatcaaggtgctgaacccctacatgcccagcgtgatcgagaagatggaggcgctgcagcggaagtacggcggggccctggtccgcaacccgctctcccggaacagcacgcacgagatgtactgggtgtccaacgccagcggcaacatcgtgtccagcgtcaacatgatctcccgcatgctgatcaaccggttcaccatgcgccacaagaaggccacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcgcctgctgaccaagccgtgggacgtgatccccatggtcacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgctccaacgccgccctcggggcgatcttcaccgacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggccaagggcagccgcgccatctggtacatgtggctgggggcgcggttcctcgagttcgaggccctgggcttcctgaacgaggaccactggttctcccgcgagaacagcctcagcggggtggagggcgaggggctgcacaagctgggctacatcctccgggacgtctccaagaaggagggcggggccatgtacgccgacgacaccgcgggctgggacacgcgcatcaccctggaggacctgaagaacgaggagatggtgaccaaccacatggagggggagcacaagaagctcgccgaggccatcttcaagctgacctaccagaacaaggtggtccgggtgcagcgccccacgccccggggcaccgtgatggacatcatcagccgccgggaccagcgcgggtccggccaggtcgtgacctacggcctgaacaccttcacgaacatggaggcccagctcatccggcagatggagggggagggcgtgttcaagagcatccagcagctgaccgtcaccgaggagatcgccgtgaagaactggctggtgcgcgtcgggcgcgagcggctctcccgcatggcgatcagcggcgacgactgcgtggtgaagcccctggacgaccggttcgcctccgccctgaccgccctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgcggggtggtccctgcaggagaccgcctgcctgggcaagagctacgcccagatgtggtccctcatgtacttccaccgccgggacctgcgcctggccgccaacgcgatctgcagcgccgtgccctcccactgggtcccgaccagccggaccacctggtccatccacgccacgcacgagtggatgaccaccgaggacatgctcaccgtgtggaaccgcgtgtggatccaggagaacccctggatggaggacaagacgcccgtcgagagctgggaggagatcccctacctgggcaagcgggaggaccagtggtgcgggagcctgatcggcctcacctcccgcgccacctgggccaagaacatccagaccgcgatcaaccaggtgcggagcctgatcgggaacgaggagtacacggactacatgccgtccatgaagcgcttccggcgcgaggaggaggaggccggcgtgctgtggtga

SEQ ID NO: 9674 - RNA, 9876 nt, synthetic construct
  misc_feature 1..9876: note = derived and/or modified CDS sequence (opt1) from DENV-2__KC762676__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccacccggggttcacgatcatggcggccatcctggcctacaccatcggcaccacccacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtctactgcgacagcaagctgatgtccgccgccatcaaggacaaccgggcggtgcacgccgacatggggtactggatcgagagcgccctcaacgacacctggaagatcgagaaggcctccttcatcgaggtcaagagctgctactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggccctgttcctcgaggagatgctgcgcacccgggtggggaccaagcacgcgatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgccctgctggccgcgttcaaggtgcggcccacgttcgccgccggcctcctgctgcgcaagctcacctccaaggagctgatgatgaccaccatcgggatcgtgctgctcagccagtccacgatccccgagaccatcctggagctgaccgacgccctcgccctgggcatgatggcgctgaagatcgtccggaacatggagaagtaccagctcgccgtgaccatcatggccatcctgtgcgtcccgaacgccgtgatcctgcagaacgcctggaaggtgagctgcacgaccctcgcggtcgtgtccgtgagccccctgctgctcacctccagccagcagaaggccgactggatccccctggccctgaccatcaaggggctcaaccccacggccatcttcctgaccaccctgtcccgcaccagcaagaagcggtcctggccgctcaacgaggcgatcatggccgtcggcatggtgagcatcctggcctccagcctgctcaagaacgacatccccatgacgggccccctggtggccgggggcctgctcaccgtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagacgctgaccatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacacgatgtggcacgtgacccgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacacgggcaccatcggggccgtgagcctggacttctcccccggcaccagcggctcccccatcgtggacaagaaggggaaggtcgtgggcctctacgggaacggcgtggtcacccggagcggcacgtacgtgtccgcgatcgcccagaccgagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggacgctgatcctggccccgacccgcgtcgtggccgccgagatggaggaggccctccgcggcctgcccatccggtaccagacccccgcgatccgcgccgagcacaccgggcgggagatcgtggacctgatgtgccacgccacgttcaccatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctccggaagaacggcaagaaggtgatccagctgagccgcaagacgttcgacttcgagtacatcaagacccggaccaacgactgggacttcgtcgtgaccacggacatctccgagatgggcgcgaacttcaaggccgagcgcgtgatcgacccccggcgctgcatgaagcccgtcatcctgaccgacggggaggagcgggtgatcctcgccggccccatgccggtgacccacagctccgccgcccagcgccgggggcgcgtcggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtggacgccatcgacggcgagtaccgcctgcgcggggaggcccgcaagacgttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctactccgaccccctggccctcaaggagttcaaggagttcgcggccggccgcaagagcctgaccctgaacctcatcaccgagatgggccgcctgcccacgttcatgacccagaaggcccggaacgccctggacaacctcgcggtcctgcacaccgccgaggccgggggccgcgcctacaaccacgccctgtccgagctccccgagaccctggagacgctgctcctgctgaccctcctggcgaccgtgaccgggggcatcttcctgttcctcatgagcggcaaggggatcggcaagatgaccctggggatgtgctgcatcatcacggcctccatcctgctctggtacgcccagatccagccgcactggatcgccgccagcatcatcctggagttcttcctgatcgtgctcctgatccccgagcccgagaagcagcggacgccccaggacaaccagctgacctacgtcgtgatcgcgatcctcaccgtggtcgccgccacgatggccaacgagatgggcttcctggagaagaccaagaaggacttcgggctgggctccatcaccacccagcagccggagagcaacatcctcgacatcgacctgcgccccgccagcgcgtggacgctgtacgccgtggccaccaccttcatcacccccatgctccggcactccatcgagaacagctccgtgaacgtcagcctgacggccatcgccaaccaggcgaccgtgctgatgggcctcgggaagggctggcccctgtccaagatggacatcggggtgagcctgctcgccatcggctgctactcccaggtcaacccgatcaccctgaccgccgccctgctcctgctggtggcgcactacgccatcatcgggcccggcctccaggccaaggccacgcgcgaggcccagaagcgggcggccgccggcatcatgaagaaccccaccgtggacgggatcaccgtcatcgacctggaccccatcccgtacgaccccaagttcgagaagcagctgggccaggtgatgctcctggtgctgtgcgtcacccaggtgctcatgatgcgcacgacctgggccctgtgcgaggccctgaccctcgcgaccgggcccatcagcacgctgtgggagggcaaccccgggcgcttctggaacaccaccatcgccgtgtccatggccaacatcttccggggcagctacctggccggcgccgggctcctgttctccatcatgaagaacaccgcgaacacgcgccggggcaccgggaacaccggcgagaccctgggcgagaagtggaagaaccgcctcaacgccctgggcaagagcgagttccagatctacaagaagtccggcatccaggaggtcgaccggacgctggccaaggaggggatcaagcgcggcgagaccgaccaccacgccgtgagccgggggtccgcgaagctccgctggttcgtggagcggaacctggtcaccccggagggcaaggtggtggacctgggctgcgggcgcggcgggtggagctactactgcggcgggctcaagaacgtcaaggaggtgaagggcctgaccaagggcgggcccggccacgaggagcccatccccatgtccacgtacgggtggaacctggtgcggctccagagcggcgtcgacgtgttcttcaccccgcccgagaagtgcgacaccctgctgtgcgacatcggggagtccagccccaaccccaccgtggaggccggccgcaccctccgggtcctgaacctggtggagaactggctcaacaacaacacgcagttctgcatcaaggtgctgaacccgtacatgcccagcgtcatcgagaagatggaggccctgcagcgcaagtacggcggggccctggtgcggaaccccctctcccgcaacagcacccacgagatgtactgggtgtccaacgccagcggcaacatcgtctccagcgtgaacatgatctcccggatgctgatcaaccgcttcaccatgcggcacaagaaggcgacctacgagccggacgtggacctggggagcggcacgcgcaacatcgggatcgagtccgagatccccaacctcgacatcatcggcaagcgcatcgagaagatcaagcaggagcacgagaccagctggcactacgaccaggaccacccctaccggacctgggcctaccacggctcctacgagaccaagcagacggggagcgcctccagcatggtcaacggcgtggtgcgcctgctgaccaagccctgggacgtcatcccgatggtgacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagacgccccggatgtgcacccgcgaggagttcacgcggaaggtgcgctccaacgcggccctcggggccatcttcaccgacgagaacaagtggaagtccgcccgggaggccgtcgaggactccggcttctgggagctggtggacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtcgagggcgaggggctgcacaagctgggctacatcctccgggacgtgtccaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtcgtgcgggtgcagcgcccgacgccccggggcaccgtcatggacatcatcagccgccgggaccagcgcgggtccggccaggtggtgacctacggcctgaacaccttcacgaacatggaggcgcagctcatccgccagatggagggggagggcgtcttcaagagcatccagcagctgaccgtgaccgaggagatcgccgtgaagaactggctggtccgggtggggcgcgagcggctctcccgcatggccatcagcggcgacgactgcgtggtcaagcccctggacgaccggttcgccaacgccctgaccgcgctcaacgacatgggcaaggtgcgcaaggacatccagcagtgggagccctcccgggggtggaacgactggacccaggtgccgttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtccccagccactgggtgcccacctcccgcaccacctggagcatccacgccacgcacgagtggatgaccaccgaggacatgctcaccgtgtggaaccgggtctggatccaggagaacccgtggatggaggacaagacgcccgtggagtcctgggaggagatcccctacctgggcaagcgcgaggaccagtggtgcgggagcctgatcggcctcaccagccgggcgacctgggccaagaacatccagaccgccatcaaccaggtgcgctccctgatcgggaacgaggagtacacggactacatgcccagcatgaagcgcttccggcgcgaggaggaggaggccggcgtcctgtggtga

SEQ ID NO: 9675 - RNA, 9876 nt, synthetic construct
  misc_feature 1..9876: note = derived and/or modified CDS sequence (opt1) from DENV-2__KC762662__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggccctgcaccaggtcttcggggcgatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggccgactccgggtgcgtggtcagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacgccaaccgggcctggaactccctggaggtggaggactacgggttcggcgtgttcaccacgaacatctggctcaagctgaaggagcgccaggacgccttctgcgacagcaagctgatgtccgccgcgatcaaggacaaccgggccgtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtggtggtcaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgacggccggccacgggcagatcgacaacttcagcctcggcgtcctgggcatggcgctgttcctcgaggagatgctgcgcacccgggtggggaccaagcacgccatcctgctcgtggccgtctccttcgtgaccctgatcacgggcaacatgagcttccgcgacctggggcgcgtgatggtcatggtgggcgccaccatgaccgacgacatcgggatgggcgtgacctacctcgccctgctggcggccttcaaggtccggcccacgttcgccgccggcctcctgctgcgcaagctcacctccaaggagctgatgatgaccaccatcgggatcacgctgctcagccagtccaccatccccgagaccatcctggagctgaccgacgccctcgcgctgggcatgatggtgctgaagatcgtgcggaacatggagaagtaccagctcgccgtcacgatcatggccatcctgtgcgtgccgaacgccgtcatcctgcagaacgcctggaaggtgagctgcaccaccctcgcggtggtctccgtgagccccctgctgctcacctccagccagcagaaggccgactggatccccctggccctgacgatcaaggggctcaaccccaccgccatcttcctgaccaccctgtcccgcacgagcaagaagcggtcctggccgctcaacgaggcgatcatggccgtgggcatggtcagcatcctggcctccagcctgctcaagaacgacatccccatgaccggccccctggtggccgggggcctgctcaccgtgtgctacgtcctgaccgggcgcagcgccgacctggagctcgagcgggcggccgacgtgcgctgggaggagcaggccgagatctccggcagctcccccatcctgagcatcacgatctccgaggacgggagcatgtccatcaagaacgaggaggaggagcagaccctgaccatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggacgttccacaccatgtggcacgtcacccgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagacgagcaccggcaccatcggggccgtctccctggacttcagccccggcacctccggcagccccatcgtggacaagaaggggaaggtggtcggcctctacgggaacggcgtggtgacgcggtccggcacctacgtcagcgcgatcgcccagaccgagaagtccatcgaggacaaccccgagatcgaggacgacatcttccgcaagaagcggctgaccatcatggacctgcaccccggggccggcaagacgaagcgctacctgcccgccatcgtgcgggaggcgatcaagcgcgggctccggaccctgatcctggccccgacccgcgtggtcgccgccgagatggaggaggccctccgcggcctgcccatccggtaccagacccccgcgatccgcgccgagcacacggggcgggagatcgtggacctgatgtgccacgccaccttcaccatgcgcctcctgtcccccatccgggtgccgaactacaacctgatcatcatggacgaggcccacttcaccgaccccgccagcatcgcggcccgcggctacatctccacgcgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagacggtgtggttcgtcccgagcatcaaggccgggaacgacatcgccgcctgcctccggaagaacggcaagaaggtgatccagctgtcccgcaagaccttcgacttcgagtacatcaagacccggaccaacgactgggacttcgtggtcacgaccgacatcagcgagatgggcgcgaacttcaaggccgagcgcgtgatcgacccccggcgctgcatgaagcccgtgatcctgaccgacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacgcccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcctaccgggtcgcggccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgaccctgaacctcatcacggagatgggccgcctgcccaccttcatgacccagaaggcccggaacgccctggacaacctcgcggtgctgcacaccgccgaggccgggggccgcgcctacaaccacgccctgagcgagctccccgagacgctggagaccctgctcctgctgaccctcctggcgaccgtcaccgggggcatcttcctgttcctcatgtccggcaagggggtgggcaagatgacgctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcacggtggtcgccgccaccatggccaacgagatgggcttcctggagaagaccaagaaggacttcgggctgggcagcatcaccacgcagcagccggagagcaacatcctcgacatcgacctgcgccccgcctccgcgtggaccctgtacgccgtggccaccaccttcatcacgcccatgctccggcacagcatcgagaactccagcgtgaacgtctccctgaccgccatcgccaaccaggcgaccgtgctgatgggcctcgggaagggctggcccctgagcaagatggacatcggggtgccgctgctcgccatcggctgctactcccaggtcaaccccatcaccctgacggccgccctgctcctgctggtggcgcactacgccatcatcgggcccggcctccaggccaaggccacccgcgaggcccagaagcgggcggccgccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcgcaccacctgggccctgtgcgaggccctgaccctcgcgacggggcccatcagcaccctgtgggagggcaacccggggcgcttctggaacaccaccatcgccgtgtccatggccaacatcttccggggcagctacctggccggcgccgggctcctgttctccatcatgaagaacacggcgaacacccgccggggcaccgggaacaccggcgagacgctgggcgagaagtggaagaaccgcctcaacgccctgggcaagagcgagttccagatctacaagaagtccggcatccaggaggtcgaccggaccctggccaaggaggggatcaagcgcggcgagaccgaccaccacgccgtgagccgggggtccgcgaagctccgctggttcgtggagcggaacctggtcacccccgagggcaaggtggtggacctgggctgcgggcgcggcgggtggagctactactgcggcgggctcaagaacgtcaaggaggtgaagggcctgacgaagggcgggcccggccacgaggagcccatcccgatgtccacctacgggtggaacctggtgcggctccagagcggcgtcgacgtgttcttcacgccgcccgagaagtgcgacaccctgctgtgcgacatcggggagtccagccccaacccgaccgtggaggccggccgcacgctccgggtcctgaacctggtggagaactggctcaacaacaacacccagttctgcatcaaggtgctgaacccctacatgcccagcgtcatcgagaagatggaggccctgcagcgcaagtacggcggggccctggtgcggaacccgctctcccgcaacagcacccacgagatgtactgggtgtccaacgccagcggcaacatcgtctccagcgtgaacatgatctcccggatgctgatcaaccgcttcaccatgcggcacaagaaggcgacgtacgagcccgacgtggacctggggagcggcacccgcaacatcgggatcgagtccgagacccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtcaacggcgtggtgcggctgctgaccaagccgtgggacgtcatccccatggtgacgcagatggccatgaccgacaccacccccttcgggcagcagcgcgtgttcaaggagaaggtcgacacgcggacccaggagcccaaggagggcaccaagaagctcatgaagatcaccgccgagtggctgtggaaggagctgggcaagaagaagacgccgcgcatgtgcacccgggaggagttcacccgcaaggtgcggtccaacgcggccctcggggccatcttcaccgacgagaacaagtggaagtccgcccgcgaggccgtcgaggactccggcttctgggagctggtggacaaggagcggaacctgcacctcgaggggaagtgcgagacgtgcgtgtacaacatgatgggcaagcgcgagaagaagctgggggagttcggcaaggcgaagggcagccgggccatctggtacatgtggctgggggcccgcttcctcgagttcgaggccctgggcttcctgaacgaggaccactggttctcccgggagaacagcctcagcggggtcgagggcgaggggctgcacaagctgggctacatcctccgcgacgtgtccaagaaggagggcggggcgatgtacgccgacgacaccgccggctgggacacccggatcaccctggaggacctgaagaacgaggagatggtgacgaaccacatggagggggagcacaagaagctcgccgaggccatcttcaagctgacctaccagaacaaggtcgtgcgcgtgcagcggcccacgccccggggcaccgtcatggacatcatcagccggcgcgaccagcgggggtccggccaggtggtgacgtacggcctgaacaccttcaccaacatggaggcgcagctcatccgccagatggagggggagggcgtcttcaagagcatccagcagctgaccgtgacggaggagatcgccgtgaagaactggctggtcaccgtggggcgcgagcggctctcccgcatggccatcagcggcgacgactgcgtggtcaagcccctggacgaccggttcgcctccgccctgaccgcgctcaacgacatgggcaaggtgcgcaaggacatccagcagtgggagccgagccgggggtggaacgactggacccaggtgcccttctgctcccaccacttccacgagctgatcatgaaggacggccgcgtcctggtggtgccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtcccctcccactgggtgccgacgagccgcaccacctggtccatccacgccacccacgagtggatgacgaccgaggacatgctcaccgtgtggaaccgggtctggatccaggagaacccctggatggaggacaagacccccgtggagagctgggaggagatcccctacctgggcaagcgcgaggaccagtggtgcgggagcctgatcggcctcacgtcccgggcgacctgggccaagaacatccagaccgccatcaaccaggtgcgcagcctgatcgggaacgaggagtacaccgactacatgccgtccatgaagcggttccgccgcgaggaggaggaggccggcgtcctgtggtga

SEQ ID NO: 9676 - RNA, 9876 nt, synthetic construct
  misc_feature 1..9876: note = derived and/or modified CDS sequence (opt1) from DENV-2__KC762661__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggccctgcaccaggtcttcggggcgatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggccgactccgggtgcgtggtcagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacgccaaccgggcctggaactccctggaggtggaggactacgggttcggcgtgttcaccacgaacatctggctcaagctgaaggagcgccaggacgccttctgcgacagcaagctgatgtccgccgcgatcaaggacaaccgggccgtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccagacccagaccgccggcccctggcacctcgggcggctggagatggacttcgacttctgcgagggcacgaccgtggtggtcaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgacggccggccacgggcagatcgacaacttcagcctcggcgtcctgggcatggcgctgttcctcgaggagatgctgcgcacccgggtggggaccaagcacgccatcctgctcgtggccgtctccttcgtgaccctgatcacgggcaacatgagcttccgcgacctggggcgcgtgatggtcatggtgggcgccaccatgaccgacgacatcgggatgggcgtgacctacctcgccctgctggcggccttcaaggtccggcccacgttcgccgccggcctcctgctgcgcaagctcacctccaaggagctgatgatgaccaccatcgggatcacgctgctcagccagtccaccatccccgagaccatcctggagctgaccgacgccctcgcgctgggcatgatggtgctgaagatcgtgcggaacatggagaagtaccagctcgccgtcacgatcatggccatcctgtgcgtgccgaacgccgtcatcctgcagaacgcctggaaggtgagctgcaccaccctcgcggtggtctccgtgagccccctgctgctcacctccagccagcagaaggccgactggatccccctggccctgacgatcaaggggctcaaccccaccgccatcttcctgaccaccctgtcccgcacgagcaagaagcggtcctggccgctcaacgaggcgatcatggccgtgggcatggtcagcatcctggcctccagcctgctcaagaacgacatccccatgaccggccccctggtggccgggggcctgctcaccgtgtgctacgtcctgaccgggcgcagcgccgacctggagctcgagcgggcggccgacgtgcgctgggaggagcaggccgagatctccggcagctcccccatcctgagcatcacgatctccgaggacgggagcatgtccatcaagaacgaggaggaggagcagaccctgaccatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggacgttccacaccatgtggcacgtcacccgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagacgagcaccggcaccatcggggccgtctccctggacttcagccccggcacctccggcagccccatcgtggacaagaaggggaaggtggtcggcctctacgggaacggcgtggtgacgcggtccggcacctacgtcagcgcgatcgcccagaccgagaagtccatcgaggacaaccccgagatcgaggacgacatcttccgcaagaagcggctgaccatcatggacctgcaccccggggccggcaagacgaagcgctacctgcccgccatcgtgcgggaggcgatcaagcgcgggctccggaccctgatcctggccccgacccgcgtggtcgccgccgagatggaggaggccctccgcggcctgcccatccggtaccagacccccgcgatccgcgccgagcacacggggcgggagatcgtggacctgatgtgccacgccaccttcaccatgcgcctcctgtcccccatccgggtgccgaactacaacctgatcatcatggacgaggcccacttcaccgaccccgccagcatcgcggcccgcggctacatctccacgcgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagacggtgtggttcgtcccgagcatcaaggccgggaacgacatcgccgcctgcctccggaagaacggcaagaaggtgatccagctgtcccgcaagaccttcgacttcgagtacatcaagacccggaccaacgactgggacttcgtggtcacgaccgacatcagcgagatgggcgcgaacttcaaggccgagcgcgtgatcgacccccggcgctgcatgaagcccgtgatcctgaccgacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacgcccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcctaccgggtcgcggccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgaccctgaacctcatcacggagatgggccgcctgcccaccttcatgacccagaaggcccggaacgccctggacaacctcgcggtgctgcacaccgccgaggccgggggccgcgcctacaaccacgccctgagcgagctccccgagacgctggagaccctgctcctgctgaccctcctggcgaccgtcaccgggggcatcttcctgttcctcatgtccggcaaggggatcggcaagatgacgctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcacggtggtggccgccaccatggccaacgagatgggcttcctggagaagaccaagaaggacttcgggctgggcagcatcaccacgcagcagccggagagcaacatcctcgacatcgacctgcgccccgcctccgcgtggaccctgtacgccgtcgccaccaccttcatcacgcccatgctccggcacagcatcgagaactccagcgtgaacgtgtccctgaccgccatcgccaaccaggcgaccgtcctgatgggcctcgggaagggctggcccctgagcaagatggacatcggggtgccgctgctcgccatcggctgctactcccaggtgaaccccatcaccctgacggccgccctgctcctgctggtcgcgcactacgccatcatcgggcccggcctccaggccaaggccacccgcgaggcccagaagcgggcggccgccggcatcatgaagaaccccaccgtggacgggatcaccgtgatcgacctggacccgatcccctacgaccccaagttcgagaagcagctgggccaggtcatgctcctggtgctgtgcgtgacgcaggtcctcatgatgcgcaccacctgggccctgtgcgaggccctgaccctcgcgacggggcccatcagcaccctgtgggagggcaacccggggcgcttctggaacaccaccatcgccgtgtccatggccaacatcttccggggcagctacctggccggcgccgggctcctgttctccatcatgaagaacacggcgaacacccgccggggcaccgggaacaccggcgagacgctgggcgagaagtggaagaaccgcctcaacgccctgggcaagagcgagttccagatctacaagaagtccggcatccaggaggtggaccggaccctggccaaggaggggatcaagcgcggcgagaccgaccaccacgccgtcagccgggggtccgcgaagctccgctggttcgtggagcggaacctggtgacccccgagggcaaggtcgtggacctgggctgcgggcgcggcgggtggagctactactgcggcgggctcaagaacgtgaaggaggtcaagggcctgacgaagggcgggcccggccacgaggagcccatcccgatgtccacctacgggtggaacctggtgcggctccagagcggcgtggacgtcttcttcacgccgcccgagaagtgcgacaccctgctgtgcgacatcggggagtccagccccaacccgaccgtggaggccggccgcacgctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctctcccgcaacagcacccacgagatgtactgggtgtccaacgccagcggcaacatcgtgtccagcgtcaacatgatctcccggatgctgatcaaccgcttcaccatgcggcacaagaaggcgacgtacgagcccgacgtggacctggggagcggcacccgcaacatcgggatcgagtccgagacccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtgaacggcgtcgtgcggctgctgaccaagccgtgggacgtgatccccatggtcacgcagatggccatgaccgacaccacccccttcgggcagcagcgcgtgttcaaggagaaggtggacacgcggacccaggagcccaaggagggcaccaagaagctcatgaagatcaccgccgagtggctgtggaaggagctgggcaagaagaagacgccgcgcatgtgcacccgggaggagttcacccgcaaggtccggtccaacgcggccctcggggccatcttcaccgacgagaacaagtggaagtccgcccgcgaggccgtggaggactccggcttctgggagctggtcgacaaggagcggaacctgcacctcgaggggaagtgcgagacgtgcgtgtacaacatgatgggcaagcgcgagaagaagctgggggagttcggcaaggcgaagggcagccgggccatctggtacatgtggctgggggcccgcttcctcgagttcgaggccctgggcttcctgaacgaggaccactggttctcccgggagaacagcctcagcggggtggagggcgaggggctgcacaagctgggctacatcctccgcgacgtctccaagaaggagggcggggcgatgtacgccgacgacaccgccggctgggacacccggatcaccctggaggacctgaagaacgaggagatggtgacgaaccacatggagggggagcacaagaagctcgccgaggccatcttcaagctgacctaccagaacaaggtggtccgcgtgcagcggcccacgccccggggcaccgtgatggacatcatcagccggcgcgaccagcgggggtccggccaggtcgtgacgtacggcctgaacaccttcaccaacatggaggcgcagctcatccgccagatggagggggagggcgtgttcaagagcatccagcagctgaccgtcacggaggagatcgccgtgaagaactggctggtgcgcgtcgggcgggagcgcctctcccggatggccatcagcggcgacgactgcgtggtgaagcccctggacgaccgcttcgcctccgccctgaccgcgctcaacgacatgggcaaggtccggaaggacatccagcagtgggagccgagccgcgggtggaacgactggacccaggtgcccttctgctcccaccacttccacgagctgatcatgaaggacggccgggtgctggtcgtgccctgccgcaaccaggacgagctcatcgggcgggcccgcatcagccagggcgccgggtggtccctgcgggagaccgcctgcctgggcaagagctacgcccagatgtggtccctcatgtacttccaccgccgggacctgcgcctggcggccaacgccatctgcagcgccgtgccctcccactgggtcccgaccagccggacgacctggtccatccacgccacccacgagtggatgaccacggaggacatgctcaccgtgtggaaccgcgtgtggatccaggagaacccctggatggaggacaagacccccgtcgagagctgggaggagatcccctacctgggcaagcgggaggaccagtggtgcgggagcctgatcggcctcacctcccgcgcgacgtgggccaagaacatccagaccgccatcaaccaggtgcggagcctgatcgggaacgaggagtacaccgactacatgccgtccatgaagcgcttccgccgggaggaggaggaggccggcgtgctgtggtga

SEQ ID NO: 9677 - RNA, 9876 nt, synthetic construct
  misc_feature 1..9876: note = derived and/or modified CDS sequence (opt1) from DENV-2__KC762655__SS-prME
  source 1..9876: mol_type = other RNA
accgcgggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaaggtggtccagcccgagaacctcgagtacaccatcgtgatcacgccccactccggcgaggagaacgccgtggggaacgacaccggcaagcacgggaaggagatcaaggtcaccccgcagagctccatcaccgaggccgagctgaccggctacgggacggtgaccatggagtgcagcccccgcaccggcctggacttcaacgagatggtgctcctgcagatggagaacaaggcctggctggtccaccggcagtggttcctcgacctgcccctgccctggctcccgggcgccgacacccaggggtccaactggatccagaaggagacgctggtgaccttcaagaacccccacgcgaagaagcaggacgtcgtggtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtcgtgaaggagatcgccgagacccagcacggcacgatcgtgatccgcgtccagtacgagggggacggcagcccctgcaagatccccttcgagatcatggacctggagaagcggcacgtgctgggccgcctcatcaccgtgaacccgatcgtcaccgagaaggactcccccgtgaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtcttcacctccatcggcaaggccctgcaccaggtgttcggggcggtgtacggcgccgccttcagcggcgtctcctggaccatgaagatcctcatcggggtggtgatcacgtggatcggcatgaacagccgctccaccagcctgtccgtcagcctggtgctggtgggggtcgtgaccctctacctgggcgtgatggtccaggccgactccgggtgcgtggtgagctggaagaacaaggagctgaagtgcggcagcggcatcttcatcaccgacaacgtccacacgtggaccgagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtgaagctgacgatcatgaccggggacatcaagggcatcatgcaggccgggaagcggagcctccgcccgcagcccaccgagctgaagtactcctggaaggcctggggcaaggcgaagatgctgagcaccgagctccacaaccacacgttcctgatcgacggccccgagaccgccgagtgcccgaacaccaaccgggcctggaactccctggaggtcgaggactacgggttcggcgtgttcaccacgaacatctggctcaagctgaaggagcgccaggacgtgttctgcgacagcaagctgatgtccgccgccatcaaggacaacaaggcggtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccggccggggtaccacacccagaccgcgggcccctggcacctcgggcgcctggagatggacttcgacttctgcgagggcacgaccgtggtggtcaccgaggactgcgggaaccggggccccagcctgcgcaccacgaccgcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtgacggccggccacgggcagatcgacaacttcagcctcggcgtcctgggcatggccctgttcctcgaggagatgctgcggacccgcgtggggaccaagcacgcgatcctgctcgtggccgtctccttcgtgaccctgatcacgggcaacatgagcttccgggacctggggcgcgtgatggtcatggtgggcgccaccatgaccgacgacatcgggatgggcgtgacctacctcgccctgctggccgcgttcaaggtccgccccacgttcgccgccggcctcctgctgcggaagctcacctccaaggagctgatgatgaccaccatcgggatcgtgctgctcagccagtccacgatccccgagaccatcctggagctgaccgacgccctcgccctgggcatgatggtcctgaagatcgtgcgcaacatggagaagtaccagctcgcggtgaccatcatggccatcctgtgcgtcccgaacgccgtgatcctgcagaacgcctggaaggtgagctgcacgaccctcgccgtcgtgtccgtgagccccctgctgctcacctccagccagcagaaggcggactggatccccctggccctgaccatcaaggggctcaaccccacggccatcttcctgaccaccctgtcccggaccagcaagaagcgctcctggccgctcaacgaggccatcatggcggtcggcatggtgagcatcctggcctccagcctgctcaagaacgacatccccatgacgggccccctggtggccgggggcctgctcaccgtctgctacgtgctgaccgggcggagcgccgacctggagctcgagcgcgccgcggacgtgcggtgggaggagcaggccgagatctccggcagctcccccatcctgagcatcaccatctccgaggacgggagcatgtccatcaagaacgaggaggaggagcagacgctgaccatcctcatccgcaccggcctgctggtcatcagcggcctcttcccggtgtccatccccatcaccgccaccgcctggtacctgtgggaggtgaagaagcagcgggccggggtcctgtgggacgtgcccagcccgccgcccgtgggcaaggcggagctcgaggacggggcctaccgcatcaagcagaagggcatcctggggtactcccagatcggcgccggcgtctacaaggaggggacgttccacaccatgtggcacgtgacccggggcgccgtgctgatgcacaaggggaagcgcatcgagcccagctgggccgacgtcaagaaggacctcatctcctacggcgggggctggaagctggagggcgagtggaaggagggggaggaggtccaggtgctggcgctcgagcccggcaagaacccccgggccgtccagaccaagcccgggctgttcaagacgaacaccggcaccatcggggccgtgagcctggacttctcccccggcaccagcggctcccccatcgtggacaagaaggggaaggtcgtgggcctctacgggaacggcgtggtcacgcgcagcggcacctacgtgtccgccatcgcccagaccgagaagtccatcgaggacaaccccgagatcgaggacgacatcttccggaagaagcgcctgaccatcatggacctgcaccccggggcgggcaagacgaagcggtacctgcccgccatcgtgcgcgaggccatcaagcgggggctccgcaccctgatcctggccccgacccgggtcgtggcggccgagatggaggaggccctccgcggcctgcccatccgctaccagacccccgccatccgggccgagcacacggggcgcgagatcgtggacctgatgtgccacgcgaccttcaccatgcggctcctgagccccatccgcgtcccgaactacaacctgatcatcatggacgaggcccacttcaccgaccccgcctccatcgccgcccggggctacatcagcacgcgcgtggagatgggcgaggcggccgggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagacggtctggttcgtgccgtccatcaaggccgggaacgacatcgcggcctgcctccgcaagaacggcaagaaggtgatccagctgagccggaagaccttcgacttcgagtacatcaagacccgcaccaacgactgggacttcgtcgtgacgaccgacatctccgagatgggcgccaacttcaaggccgagcgggtgatcgacccccgccggtgcatgaagcccgtcatcctgaccgacggggaggagcgcgtgatcctcgcgggccccatgccggtgacccacagctccgccgcccagcggcgcgggcgggtcggccgcaaccccaagaacgagaacgaccagtacatctacatgggggagcccctggagaacgacgaggactgcgcccactggaaggaggccaagatgctgctcgacaacatcaacacgcccgagggcatcatcccgagcatgttcgagcccgagcgcgagaaggtggacgcgatcgacggcgagtaccggctgcgcggggaggcccggaagaccttcgtcgacctgatgcgccggggcgacctccccgtgtggctggcctaccgcgtggccgccgaggggatcaactacgcggaccggcgctggtgcttcgacggcgtcaagaacaaccagatcctggaggagaacgtggaggtggagatctggaccaaggagggggagcggaagaagctcaagccgcgctggctggacgcccggatctactccgaccccctggccctcaaggagttcaaggagttcgccgccggccgcaagagcctgaccctgaacctcatcacggagatgggccggctgcccaccttcatgacccagaaggcgcgcaacgccctggacaacctcgccgtcctgcacaccgccgaggccgggggccgggcctacaaccacgccctgtccgagctccccgagacgctggagaccctgctcctgctgaccctcctggccaccgtgaccgggggcatcttcctgttcctcatgagcggcaaggggatcggcaagatgacgctggggatgtgctgcatcatcaccgcctccatcctgctctggtacgcgcagatccagccgcactggatcgccgccagcatcatcctggagttcttcctgatcgtgctcctgatccccgagcccgagaagcagcgcacgccccaggacaaccagctgacctacgtcgtgatcgccatcctcacggtggtcgccgcgaccatggccaacgagatgggcttcctggagaagaccaagaaggacttcgggctgggctccatcgccacccagcagccggagagcaacatcctcgacatcgacctgcggcccgccagcgcctggacgctgtacgcggtggccaccaccttcatcacccccatgctccgccactccatcgagaacagctccgtgaacgtcagcctgacggccatcgccaaccaggccaccgtgctgatgggcctcgggaagggctggcccctgtccaagatggacatcggggtgccgctgctcgcgatcggctgctacagccaggtcaaccccatcaccctgaccgccgccctgctcctgctggtggcccactacgcgatcatcgggcccggcctccaggccaaggccacgcgggaggcccagaagcgcgccgcggccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcggacgacctgggccctgtgcgaggccctgaccctcgccaccgggcccatctccacgctgtgggagggcaacccggggcgcttctggaacaccaccatcgcggtgagcatggccaacatcttccgcggctcctacctggccggcgccgggctcctgttcagcatcatgaagaacaccgccaacacgcggcgcggcaccgggaacaccggcgagaccctgggcgagaagtggaagaaccggctcaacgcgctggggaagtccgagttccagatctacaagaagtccggcatccaggaggtcgaccgcacgctggccaaggaggggatcaagcggggcgagaccgaccaccacgccgtgtcccgcgggagcgccaagctccggtggttcgtggagcgcaacctggtcacccccgagggcaaggtggtggacctgggctgcgggcggggcgggtggtcctactactgcggcgggctcaagaacgtcaaggaggtgaagggcctgaccaagggcgggcccggccacgaggagcccatcccgatgagcacgtacgggtggaacctggtgcgcctccagtccggcgtcgacgtgttcttcacgccgcccgagaagtgcgacaccctgctgtgcgacatcggggagagctcccccaacccgaccgtggaggcgggccggaccctccgcgtcctgaacctggtggagaactggctcaacaacaacacgcagttctgcatcaaggtgctgaacccctacatgcccagcgtcatcgagaagatggaggccctgcagcggaagtacggcggggccctggtgcgcaacccgctcagccggaactccacccacgagatgtactgggtgagcaacgcctccggcaacatcgtcagctccgtgaacatgatcagccgcatgctgatcaaccggttcaccatgcgccacaagaaggccacctacgagcccgacgtggacctggggtccggcacgcggaacatcgggatcgagagcgagacccccaacctcgacatcatcggcaagcgcatcgagaagatcaagcaggagcacgagacctcctggcactacgaccaggaccacccctacaagacctgggcgtaccacggcagctacgagacgaagcagaccgggtccgccagctccatggtcaacggcgtggtgcgcctgctgaccaagccgtgggacgtcatccccatggtgacccagatggccatgacggacaccacccccttcgggcagcagcgggtcttcaaggagaaggtggacacccgcacgcaggagcccaaggagggcaccaagaagctcatgaagatcaccgccgagtggctgtggaaggagctgggcaagaagaagaccccgcggatgtgcacgcgcgaggagttcacccggaaggtgcgcagcaacgccgcgctcggggccatcttcaccgacgagaacaagtggaagtccgcccgggaggccgtcgaggacagcggcttctgggagctggtggacaaggagcgctccctgcacctcgaggggaagtgcgagacctgcgtgtacaacatgatgggcaagcgggagaagaagctgggggagttcggcaaggccaagggcagccgcgcgatctggtacatgtggctgggggcccggttcctcgagttcgaggccctgggcttcctgaacgaggaccactggttctcccgcgagaacagcctcagcggggtcgagggcgaggggctgcacaagctgggctacatcctccgggacgtgtccaagaaggagggcggggccatgtacgcggacgacacggccggctgggacacccgcatcaccctggaggacctgaagaacgaggagatggtgaccaaccacatggagggggagcacaagaagctcgccgaggccatcttcaagctgacgtaccagaacaaggtcgtgcgggtgcagcgccccacgccccggggcatcgtcatggacatcatcagccgccgggaccagcgcgggtccggccaggtggtgacctacggcctgaacaccttcacgaacatggaggcccagctcatccggcagatggagggggagggcgtcttcaagagcatccagcagctgaccgtgaccgaggagatcgcggtgaagaactggctggcccgcgtcgggcgcgagcggctctcccgcatggccatcagcggcgacgactgcgtggtgaagcccctggacgaccggttcgcctccgccctgaccgcgctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtgccctcccactgggtcccgaccagccgcaccacctggtccatccacgccacgcacgagtggatgaccaccgaggacatgctcaccgtgtggaaccgggtgtggatccaggagaacccctggatggaggacaagacgcccgtcgagagctgggaggagatcccctacctgggcaagcgcgaggaccagtggtgcgggagcctgatcggcctcacctcccgggcgacctgggcccgcaacatccagaccgccatcaaccaggtgcggagcctgatcgggaacgaggagtacacggactacatgccgtccatgaagcgcttccgccgggaggaggaggaggccggcgtgctgtggtga

SEQ ID NO: 9678 - RNA, 9876 nt, synthetic construct
  misc_feature 1..9876: note = derived and/or modified CDS sequence (opt1) from DENV-2__KC762656__SS-prME
  source 1..9876: mol_type = other RNA
accgccggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacgcgcgccgagacctggatgtccagcgagggcgcctggaagcacgcgcagcggatcgagacctgggtcctccgccaccccgggttcaccatcatggccgccatcctggcctacacgatcggcaccacctacttccagcgggtgctgatcttcatcctcctgaccgcggtgacgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcgggaccatctacggcgccgccttcagcggcgtgtcctggaccatgaagatcctcatcggggtcgtgatcacgtggatcggcatgaacagccgctccaccagcctgtccgtgagcctggtcctggtgggggtggtcaccctctacctgggcgtgatggtgcaggccgactccgggtgcgtcgtgagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtcacccgcctggagaacctgatgtggaagcagatcacccccgagctcaaccacatcctgtccgagaacgaggtgaagctgacgatcatgaccggggacatcaagggcatcatgcaggccgggaagcggagcctccgcccgcagcccaccgagctgaagtactcctggaaggcctggggcaaggcgaagatgctgagcaccgagctccacaaccacacgttcctgatcgacggccccgagaccgccgagtgcccgaacaccaaccgggcctggaactccctggaggtggaggactacgggttcggcgtcttcaccacgaacatctggctcaagctgaaggagcgccaggacgtgttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccagtggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtcgtggtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacgggcagatcgacaacttcagcctcggcgtgctgggcatggccctgttcctcgaggagatgctgcgcacccgggtcgggaccaagcacgcgatcctgctcgtggccgtgtccttcgtcaccctgatcacgggcaacatgagcttccgcgacctggggcgcgtgatggtgatggtcggcgccaccatgaccgacgacatcgggatgggcgtgacctacctcgccctgctggccgcgttcaaggtgcggcccacgttcgccgccggcctcctgctgcgcaagctcacctccaaggagctgatgatgaccaccatcgggatcgtcctgctcagccagtccacgatccccgagaccatcctggagctgaccgacgccctcgccctgggcatgatggtgctgaagatcgtccggaacatggagaagtaccagctcgcggtgaccatcatggccatcctgtgcgtgccgaacgccgtcatcctgcagaacgcctggaaggtgagctgcacgaccctcgccgtggtctccgtgagccccctgctgctcacctccagccagcagaaggcggactggatccccctggccctgaccatcaaggggctcaaccccacggccatcttcctgaccaccctgtcccgcaccagcaagaagcggtcctggccgctcaacgaggccatcatggcggtgggcatggtcagcatcctggcctccagcctgctcaagaacgacatccccatgacgggccccctggtggccgggggcctgctcaccgtgtgctacgtcctgaccgggcgcagcgccgacctggagctcgagcgggccgcggacgtgcgctgggaggagcaggccgagatctccggcagctcccccatcctgagcatcaccatctccgaggacgggagcatgtccatcaagaacgaggaggaggagcagacgctgaccatcctcatccggaccggcctgctggtggtcagcggcctcttcccggtgtccatccccatcaccgccgccgcctggtacctgtgggaggtgaagaagcagcgcgcgggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacacgatgtggcacgtgacccgcggcgccgtgctgatgcacaaggggaagcggatcgagcccagctgggcggacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacacgggcaccatcggggccgtgagcctggacttctcccccggcaccagcggctcccccatcgtggacaagaaggggaaggtcgtgggcctctacgggaacggcgtggtcacccggagcggcacgtacgtgtccgccatcgcgcagaccgagaagtccatcgaggacaaccccgagatcgaggacgacatcttccgcaagaagcggctgaccatcatggacctgcaccccggggccggcaagaccaagcgctacctgcccgccatcgtgcgggaggccatcaagcgcgggctccggacgctgatcctggcgccgacccgcgtcgtggccgccgagatggaggaggccctccgcggcctgcccatccggtaccagacccccgccatccgcgcggagcacaccgggcgggagatcgtggacctgatgtgccacgccacgttcaccatgcgcctcctgagccccatccgggtcccgaactacaacctgatcatcatggacgaggcccacttcaccgaccccgcctccatcgccgcgcgcggctacatcagcacccgggtggagatgggcgaggccgccgggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggcggggaacgacatcgccgcctgcctccggaagaacggcaagaaggtgatccagctgagccgcaagacgttcgacttcgagtacatcaagacccggaccaacgactgggacttcgtcgtgaccacggacatctccgagatgggcgccaacttcaaggcggagcgcgtgatcgacccccggcgctgcatgaagcccgtcatcctgaccgacggggaggagcgggtgatcctcgccggccccatgccggtgacccacagctccgccgcccagcgccgggggcgcgtcggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccgcaagacgttcgtcgacctgatgcggcgcggcgacctccccgtgtggctggcctaccgggtggccgcggaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctactccgaccccctggccctcaaggagttcaaggagttcgccgcgggccgcaagagcctgaccctgaacctcatcaccgagatgggccgcctgcccacgttcatgacccagaaggcccggaacgccctggacaacctcgccgtcctgcacaccgcggaggccgggggccgcgcctacaaccacgccctgtccgagctccccgagaccctggagacgctgctcctgctgaccctcctggccaccgtgaccgggggcatcttcctgttcctcatgagcggcaaggggatcggcaagatgaccctggggatgtgctgcatcatcacggcgtccatcctgctctggtacgcccagatccagccgcactggatcgccgccagcatcatcctggagttcttcctgatcgtgctcctgatccccgagcccgagaagcagcggacgccccaggacaaccagctgacctacgtcgtgatcgccatcctcaccgtggtcgcggccacgatggccaacgagatgggcttcctggagaagaccaagaaggacttcgggctgggctccatcgccacccagcagccggagagcaacatcctcgacatcgacctgcgccccgccagcgcgtggaccctgtacgccgtggccacgaccttcatcacccccatgctccggcactccatcgagaacagctccgtgaacgtcagcctgaccgccatcgccaaccaggcgacggtgctgatgggcctcgggaagggctggcccctgtccaagatggacatcggggtgccgctgctcgccatcggctgctacagccaggtcaaccccatcaccctgaccgccgccctgctcctgctggtggcgcactacgccatcatcgggcccggcctccaggccaaggccacccgcgaggcccagaagcgggcggccgccggcatcatgaagaaccccacggtggacgggatcaccgtcatcgacctggacccgatcccctacgaccccaagttcgagaagcagctgggccaggtgatgctcctggtgctgtgcgtcacccaggtgctcatgatgcgcaccacgtgggccctgtgcgaggccctgaccctcgcgaccgggcccatctccaccctgtgggagggcaacccggggcgcttctggaacacgaccatcgccgtgagcatggccaacatcttccggggctcctacctggccggcgccgggctcctgttcagcatcatgaagaacaccgcgaacacccgccggggcacggggaacaccggcgagaccctgggcgagaagtggaagaaccgcctcaacgccctggggaagtccgagttccagatctacaagaagtccggcatccaggaggtcgaccggaccctggccaaggaggggatcaagcgcggcgagacggaccaccacgccgtgtcccgggggagcgcgaagctccgctggttcgtggagcggaacctggtcacccccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacctacgggtggaacctggtgcggctccagtccggcgtcgacgtgttcttcacgccgcccgagaagtgcgacaccctgctgtgcgacatcggggagagctcccccaacccgaccgtggaggccggccgcaccctccgggtcctgaacctggtggagaactggctcaacaacaacacccagttctgcatcaaggtgctgaacccctacatgcccagcgtcatcgagaagatggaggccctgcagcgcaagtacggcggggccctggtgcggaacccgctcagccgcaactccacgcacgagatgtactgggtgagcaacgcctccggcaacatcgtcagctccgtgaacatgatcagccggatgctgatcaaccgcttcaccatgcggcacaagaaggcgacctacgagcccgacgtggacctggggtccggcacccgcaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtcaacggcgtggtgcggctgctgaccaagccgtgggacgtcatccccatggtgacccagatggccatgaccgacacgacccccttcgggcagcagcgcgtcttcaaggagaaggtggacacccggacccaggagcccaaggagggcacgaagaagctcatgaagatcaccgccgagtggctgtggaaggagctgggcaagaagaagaccccgcgcatgtgcacccgggaggagttcacgcgcaaggtgcggagcaacgcggccctcggggccatcttcaccgacgagaacaagtggaagtccgcccgcgaggccgtcgaggacagcggcttctgggagctggtggacaaggagcggaacctgcacctcgaggggaagtgcgagacctgcgtgtacaacatgatgggcaagcgcgagaagaagctgggggagttcggcaaggcgaagggctcccgggccatctggtacatgtggctgggggcccgcttcctcgagttcgaggccctgggcttcctgaacgaggaccactggttcagccgggagaactccctcagcggggtcgagggcgaggggctgcacaagctgggctacatcctccgcgacgtgagcaagaaggagggcggggcgatgtacgccgacgacaccgccggctgggacacgcggatcaccctggaggacctgaagaacgaggagatggtgaccaaccacatggagggggagcacaagaagctcgccgaggccatcttcaagctgacctaccagaacaaggtcgtgcgcgtgcagcggcccacgccccgcggcaccgtcatggacatcatctcccggcgcgaccagcgggggagcggccaggtggtgacctacggcctgaacaccttcacgaacatggaggcgcagctcatccgccagatggagggggagggcgtcttcaagtccatccagcagctgaccgtgaccgaggagatcgccgtgaagaactggctggtccgcgtggggcgggagcgcctcagccggatggccatctccggcgacgactgcgtggtcaagcccctggacgaccgcttcgccagcgccctgaccgcgctcaacgacatgggcaaggtgcggaaggacatccagcagtgggagccgtcccgcgggtggaacgactggacccaggtgcccttctgcagccaccacttccacgagctgatcatgaaggacggccgggtcctggtggtgccctgccgcaaccaggacgagctcatcgggcgggcccgcatctcccagggcgccgggtggagcctgcgggagaccgcctgcctgggcaagtcctacgcccagatgtggagcctcatgtacttccaccgccgggacctgcgcctggcggccaacgccatctgctccgccgtccccagccactgggtgccgacctcccggaccacctggagcatccacgccacgcacgagtggatgaccaccgaggacatgctcaccgtgtggaaccgcgtctggatccaggagaacccctggatggaggacaagacgcccgtggagtcctgggaggagatcccctacctgggcaagcgggaggaccagtggtgcgggagcctgatcggcctcaccagccgcgcgacctgggccaagaacatccagaccgccatcaaccaggtgcggtccctgatcgggaacgaggagtacacggactacatgccgagcatgaagcgcttccgccgggaggaggaggaggccggcgtcctgtggtga

SEQ ID NO: 9679 - RNA, 9876 nt, synthetic construct
  misc_feature 1..9876: note = derived and/or modified CDS sequence (opt1) from DENV-2__KC762673__SS-prME
  source 1..9876: mol_type = other RNA
accgccggcatcatcatcatgatgatccccaccgtgatggccttccacctgaccacccgcaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacccacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgcccctgagcgtgtccctggtgctggtcggggtggtgaccctctacctgggcgtcatggtgcaggcggacagcgggtgcgtggtctcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtgacccgcctggagaacctgatgtggaagcagatcaccccggagctcaaccacatcctgagcgagaacgaggtcaagctgaccatcatgacgggggacatcaagggcatcatgcaggccgggaagcggtccctccgcccccagcccaccgagctgaagtacagctggaagacctggggcaaggcgaagatgctgtccaccgagctccacaaccacacgttcctgatcgacggcccggagaccgccgagtgccccaacaccaaccgggcctggaacagcctggaggtggaggactacgggttcggcgtgttcaccacgaacatctggctcaagctgaaggagcgccaggacgtctactgcgactccaagctgatgagcgccgccatcaaggacaaccgggcggtgcacgccgacatggggtactggatcgagtccgccctcaacgacacctggaagatcgagaaggccagcttcatcgaggtgaagtcctgctactggcccaagagccacaccctgtggtccaacggcgtcctggagagcgagatgatcatccccaagaacttcgccggcccggtgtcccagcacaactaccgccccgggtaccacacccagaccgcgggcccctggcacctcgggcggctggagatggacttcgacttctgcgagggcacgaccgtggtcgtgaccgaggactgcgggaaccgcggccccagcctgcggaccacgaccgccagcggcaagctcatcaccgagtggtgctgccgctcctgcaccctgccgcccctgcggtaccgcggggaggacggctgctggtacgggatggagatccggcccctcaaggagaaggaggagaacctggtgaacagcctggtcacggccggccacgggcagatcgacaacttctccctcggcgtgctgggcatggccctgttcctcgaggagatgctgcgcacccgggtggggaccaagcacgcgatcctgctcgtcgccgtgagcttcgtgaccctgatcacgggcaacatgtccttccgcgacctggggcgcgtcatggtgatggtgggcgccaccatgaccgacgacatcgggatgggcgtcacctacctcgccctgctggccgcgttcaaggtgcggcccacgttcgccgccggcctcctgctgcgcaagctcaccagcaaggagctgatgatgaccaccatcgggatcgtgctgctctcccagagcacgatcccggagaccatcctggagctgaccgacgccctcgccctgggcatgatggcgctgaagatcgtccggaacatggagaagtaccagctcgccgtgaccatcatggccatcctgtgcgtccccaacgccgtgatcctgcagaacgcctggaaggtgtcctgcacgaccctcgcggtcgtgagcgtgagccccctgctgctcaccagctcccagcagaaggccgactggatccccctggccctgaccatcaaggggctcaacccgacggccatcttcctgaccaccctgagccgcacctccaagaagcggagctggcccctcaacgaggcgatcatggccgtcggcatggtgtccatcctggccagctccctgctcaagaacgacatccccatgacgggccccctggtggccgggggcctgctcaccgtctgctacgtgctgaccgggcgcagcgccgacctggagctcgagcgggcggccgacgtgcgctgggaggagcaggccgagatcagcggctccagcccgatcctgtccatcaccatcagcgaggacgggtccatgagcatcaagaacgaggaggaggagcagacgctgaccatcctcatccggaccggcctgctggtcatctccggcctcttccccgtgagcatccccatcaccgccgccgcgtggtacctgtgggaggtgaagaagcagcgcgccggggtcctgtgggacgtgccctccccgccgcccgtgggcaaggccgagctcgaggacggggcctaccggatcaagcagaagggcatcctggggtacagccagatcggcgccggcgtctacaaggaggggaccttccacacgatgtggcacgtgacccgcggcgcggtgctgatgcacaaggggaagcggatcgagccgtcctgggccgacgtcaagaaggacctcatcagctacggcgggggctggaagctggagggcgagtggaaggagggggaggaggtccaggtgctggccctcgagcccggcaagaacccccgcgccgtccagaccaagcccgggctgttcaagaccaacacgggcaccatcggggccgtgtccctggacttcagcccgggcacctccggcagccccatcgtggacaagaaggggaaggtcgtgggcctctacgggaacggcgtggtcacccggtccggcacgtacgtgagcgcgatcgcccagaccgagaagtccatcgaggacaaccccgagatcgaggacgacatcttccgcaagaagcggctgaccatcatggacctgcaccccggggccggcaagaccaagcgctacctgccggccatcgtgcgggaggcgatcaagcgcgggctccggacgctgatcctggcccccacccgcgtcgtggccgccgagatggaggaggccctccgcggcctgcccatccggtaccagacccccgcgatcaaggccgagcacaccgggcgcgagatcgtggacctgatgtgccacgccacgttcaccatgcggctcctgagcccgatccgcgtccccaactacaacctgatcatcatggacgaggcccacttcaccgaccccgccagcatcgcggcccggggctacatctccacccgcgtggagatgggcgaggccgccgggatcttcatgacggccacgccgcccggcagccgggaccccttcccccagtccaacgcgcccatcatggacgaggagcgcgagatccccgagcggagctggaactccgggcacgagtgggtgaccgacttcaagggcaagaccgtctggttcgtgcccagcatcaaggccgggaacgacatcgccgcctgcctccgcaagaacggcaagaaggtgatccagctgtcccggaagacgttcgacttcgagtacatcaagacccgcaccaacgactgggacttcgtcgtgaccacggacatcagcgagatgggcgcgaacttcaaggccgagcgggtgatcgacccccgccggtgcatgaagcccgtcatcctgaccgacggggaggagcgcgtgatcctcgccggcccgatgcccgtgacccactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacaccccggagggcatcatcccctccatgttcgagcccgagcgcgagaaggtggacgccatcgacggcgagtaccggctgcgcggggaggcccggaagacgttcgtggacctgatgcgccggggcgacctcccggtctggctggcctaccgcgtggcggccgaggggatcaactacgccgaccggcgctggtgcttcgacggcgtcaagaacaaccagatcctggaggagaacgtggaggtggagatctggaccaaggagggggagcggaagaagctcaagccccgctggctggacgcccggatctacagcgaccccctggccctcaaggagttcaaggagttcgcggccggccgcaagtccctgaccctgaacctcatcaccgagatgggccggctgcccacgttcatgacccagaaggcccgcaacgccctggacaacctcgcggtcctgcacaccgccgaggccgggggccgggcctacaaccacgccctgagcgagctcccggagaccctggagacgctgctcctgctgaccctcctggcgaccgtgaccgggggcatcttcctgttcctcatgtccggcaaggggatcggcaagatgaccctggggatgtgctgcatcatcacggccagcatcctgctctggtacgcccagatccagccccactggatcgccgcctccatcatcctggagttcttcctgatcgtgctcctgatccccgagcccgagaagcagcgcaccccgcaggacaaccagctgacctacgtcgtgatcgcgatcctcaccgtggtcgccgccacgatggccaacgagatgggcttcctggagaagaccaagaaggacttcgggctgggcagcatcaccacccagcagcccgagtccaacatcctcgacatcgacctgcggcccgccagcgcgtggacgctgtacgccgtggccaccaccttcatcacccccatgctccgccacagcatcgagaactccagcgtgaacgtctccctgacggccatcgccaaccaggcgaccgtgctgatgggcctcgggaagggctggccgctgagcaagatggacatcggggtgcccctgctcgccatcggctgctactcccaggtcaaccccatcaccctgaccgccgccctgctcctgctggtggcgcactacgccatcatcgggcccggcctccaggccaaggccacgcgggaggcccagaagcgcgcggccgccggcatcatgaagaacccgaccgtggacgggatcaccgtcatcgacctggaccccatcccctacgaccccaagttcgagaagcagctgggccaggtgatgctcctggtgctgtgcgtcacccaggtgctcatgatgcggacgacctgggccctgtgcgaggccctgaccctcgcgaccgggccgatcagcacgctgtgggagggcaaccccgggcgcttctggaacaccaccatcgccgtgtccatggccaacatcttccgcggcagctacctggccggcgccgggctcctgttctccatcatgaagaacaccgcgaacacgcggcgcggcaccgggaacaccggcgagaccctgggcgagaagtggaagaaccggctcaacgccctggggaagtccgagttccagatctacaagaagtccggcatccaggaggtcgaccgcacgctggccaaggaggggatcaagcggggcgagaccgaccaccacgccgtgagccgcgggtccgcgaagctccggtggttcgtggagcgcaacctggtcacccccgagggcaaggtggtggacctgggctgcgggcggggcgggtggagctactactgcggcgggctcaagaacgtcaaggaggtgaagggcctgaccaagggcgggcccggccacgaggagccgatccccatgtccacgtacgggtggaacctggtgcgcctccagagcggcgtcgacgtgttcttcacgccgcccgagaagtgcgacaccctgctgtgcgacatcggggagtccagcccgaaccccaccgtggaggccggccggaccctccgcgtcctgaacctggtggagaactggctcaacaacaacacgcagttctgcatcaaggtgctgaacccctacatgccgtccgtcatcgagaagatggaggccctgcagcggaagtacggcggggccctggtgcgcaaccccctcagccggaacagcacccacgagatgtactgggtgtccaacgccagcggcaacatcgtctccagcgtgaacatgatctcccgcatgctgatcaaccggttcaccatgcgccacaagaaggcgacctacgagcccgacgtggacctggggagcggcacgcggaacatcgggatcgagtccgagatccccaacctcgacatcatcggcaagcgcatcgagaagatcaagcaggagcacgagaccagctggcactacgaccaggaccacccgtaccgcacctgggcctaccacggctcctacgagaccaagcagacggggagcgcctccagcatggtcaacggcgtggtgcggctgctgaccaagccctgggacgtcatccccatggtgacccagatggccatgaccgacacgacccccttcgggcagcagcgcgtgttcaaggagaaggtcgacacccggacccaggagccgaaggagggcacgaagaagctcatgaagatcaccgccgagtggctgtggaaggagctgggcaagaagaagacgccccgcatgtgcacccgggaggagttcacgcgcaaggtgcggtccaacgcggccctcggggccatcttcaccgacgagaacaagtggaagtccgcccgcgaggccgtcgaggactccggcttctgggagctggtggacaaggagcggaacctgcacctcgaggggaagtgcgagacctgcgtgtacaacatgatgggcaagcgcgagaagaagctgggggagttcggcaaggcgaagggcagccgggccatctggtacatgtggctgggggcccgcttcctcgagttcgaggccctgggcttcctgaacgaggaccactggttctcccgggagaacagcctctccggggtcgagggcgaggggctgcacaagctgggctacatcctccgcgacgtgagcaagaaggagggcggggcgatgtacgccgacgacaccgccggctgggacacgcggatcaccctggaggacctgaagaacgaggagatggtgaccaaccacatggagggggagcacaagaagctcgccgaggccatcttcaagctgacctaccagaacaaggtcgtgcgcgtgcagcggcccacgccccgcggcaccgtcatggacatcatcagccggcgcgaccagcgggggtccggccaggtggtgacctacggcctgaacaccttcacgaacatggaggcgcagctcatccgccagatggagggggagggcgtcttcaagagcatccagcagctgaccgtgaccgaggagatcgccgtgaagaactggctggtccgcgtggggcgggagcgcctctcccggatggccatcagcggcgacgactgcgtggtcaagccgctggacgaccgcttcgcctccgccctgaccgcgctcaacgacatgggcaaggtgcggaaggacatccagcagtgggagcccagccgcgggtggaacgactggacccaggtgcccttctgctcccaccacttccacgagctgatcatgaaggacggccgggtcctggtggtgccctgccgcaaccaggacgagctcatcgggcgggcccgcatcagccagggcgccgggtggtccctgcgggagaccgcctgcctgggcaagagctacgcccagatgtggtccctcatgtacttccaccgccgggacctgcgcctggcggccaacgccatctgcagcgccgtcccgtcccactgggtgcccaccagccggaccacctggtccatccacgccacgcacgagtggatgaccaccgaggacatgctcaccgtgtggaaccgcgtctggatccaggagaacccctggatggaggacaagacgcccgtggagagctgggaggagatcccgtacctgggcaagcgggaggaccagtggtgcgggtccctgatcggcctcaccagccgcgcgacctgggccaagaacatccagaccgccatcaaccaggtgcggagcctgatcgggaacgaggagtacacggactacatgccctccatgaagcgcttccgccgggaggaggaggaggccggcgtcctgtggtga

SEQ ID NO: 9680 - RNA, 9876 nt, synthetic construct
  misc_feature 1..9876: note = derived and/or modified CDS sequence (opt1) from DENV-2__KC762663__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcaccgacctggagaagcggcacgtcctgggccgcctcatcaccgtgaacccgatcgtgaccgagaaggactcccccgtcaacatcgaggcggagccgcccttcggggacagctacatcatcatcggcgtggagccggggcagctgaagctgtcctggttcaagaagggcagctccatcgggcagatgttcgagacgaccatgcgcggcgccaagcggatggccatcctcggcgacaccgcctgggacttcgggagcctgggcggggtgttcacctccatcggcaaggccctgcaccaggtcttcggggcgatctacggcgccgccttcagcggcgtgtcctggacgatgaagatcctcatcggggtggtcatcacctggatcggcatgaacagccgctccaccagcctgtccgtgagcctggtgctggtcggggtggtgaccctctacctgggcgtcatggtgcaggccgactccgggtgcgtggtcagctggaagaacaaggagctgaagtgcggcagcggcatcttcatcacggacaacgtgcacacctggaccgagcagtacaagttccagcccgagtcccccagcaagctcgcgtccgccatccagaaggcccacgaggaggggatctgcggcatccggagcgtgacccgcctggagaacctgatgtggaagcagatcacgcccgagctcaaccacatcctgtccgagaacgaggtcaagctgaccatcatgaccggggacatcaagggcatcatgcaggccgggaagcggagcctccgcccgcagcccaccgagctgaagtactcctggaagacgtggggcaaggccaagatgctgagcaccgagctccacaaccacaccttcctgatcgacggccccgagaccgcggagtgcccgaacgccaaccgggcctggaactccctggaggtggaggactacgggttcggcgtgttcacgaccaacatctggctcaagctgaaggagcgccaggacgccttctgcgacagcaagctgatgtccgccgcgatcaaggacaaccgggccgtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagacggccggcccctggcacctcgggcggctggagatggacttcgacttctgcgagggcaccaccgtggtggtcaccgaggactgcgggaaccgcggccccagcctgcggacgaccaccgcctccggcaagctcatcaccgagtggtgctgccgcagctgcacgctgcccccgctgcggtaccgcggggaggacggctgctggtacgggatggagatccggcccctcaaggagaaggaggagaacctggtgaactccctggtgaccgccggccacgggcagatcgacaacttcagcctcggcgtcctgggcatggcgctgttcctcgaggagatgctgcgcacccgggtggggaccaagcacgccatcctgctcgtggccgtctccttcgtgacgctgatcaccggcaacatgagcttccgcgacctggggcgcgtgatggtcatggtgggcgccaccatgaccgacgacatcgggatgggcgtgacgtacctcgccctgctggcggccttcaaggtccggcccaccttcgccgccggcctcctgctgcgcaagctcacctccaaggagctgatgatgaccacgatcgggatcaccctgctcagccagtccaccatccccgagaccatcctggagctgacggacgccctcgcgctgggcatgatggtgctgaagatcgtgcggaacatggagaagtaccagctcgccgtcaccatcatggccatcctgtgcgtgccgaacgccgtcatcctgcagaacgcctggaaggtgagctgcaccaccctcgcggtggtctccgtgagccccctgctgctcacgtccagccagcagaaggccgactggatccccctggccctgaccatcaaggggctcaaccccaccgccatcttcctgaccacgctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcaccgtgtgctacgtcctgacggggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgaccatcctcatccggaccggcctgctggtgatcagcggcctcttcccggtctccatccccatcacggccgccgcgtggtacctgtgggaggtgaagaagcagcgcgccggggtgctgtgggacgtccccagcccgccgcccgtggagaaggccgagctcgaggacggcgcctaccggatcaagcagaaggggatcctgggctactcccagatcggggccggcgtgtacaaggagggcaccttccacaccatgtggcacgtcacccgcggggcggtgctgatgcacaagggcaagcggatcgagcccagctgggccgacgtgaagaaggacctcatctcctacgggggcgggtggaagctggagggcgagtggaaggagggcgaggaggtccaggtgctggccctcgagcccgggaagaacccccgcgccgtgcagacgaagcccggcctgttcaagaccagcaccgggaccatcggcgccgtctccctggacttcagccccgggacgtccggcagccccatcgtggacaagaagggcaaggtggtcgggctctacggcaacggggtggtgacccggtccggcacctacgtcagcgcgatcgcccagaccgagaagtccatcgaggacaaccccgagatcgaggacgacatcttccgcaagaagcggctgacgatcatggacctgcaccccggcgccgggaagaccaagcgctacctgcccgccatcgtgcgggaggcgatcaagcgcggcctccggaccctgatcctggccccgacccgcgtggtcgccgccgagatggaggaggccctccgcgggctgcccatccggtaccagacgcccgcgatccgcgccgagcacaccggccgggagatcgtggacctgatgtgccacgccaccttcaccatgcgcctcctgtcccccatccgggtgccgaactacaacctgatcatcatggacgaggcccacttcacggaccccgccagcatcgcggcccgcgggtacatctccacccgggtcgagatgggcgaggccgccggcatcttcatgaccgccacgccgcccgggagccgcgacccgttcccccagtccaacgcgcccatcatggacgaggagcgggagatccccgagcgcagctggaactccggccacgagtgggtgacggacttcaaggggaagaccgtgtggttcgtcccgagcatcaaggccggcaacgacatcgccgcctgcctccggaagaacgggaagaaggtgatccagctgtcccgcaagaccttcgacttcgagtacatcaagacccggacgaacgactgggacttcgtggtcaccaccgacatcagcgagatgggcgcgaacttcaaggccgagcgcgtgatcgacccccggcgctgcatgaagcccgtgatcctgaccgacggcgaggagcgggtcatcctcgccgggcccatgccggtgacgcactccagcgccgcccagcgccggggccgcgtggggcgcaaccccaagaacgagaacgaccagtacatctacatgggcgagcccctggagaacgacgaggactgcgcgcactggaaggaggccaagatgctgctcgacaacatcaacacccccgaggggatcatcccgtccatgttcgagcccgagcgggagaaggtcgacgccatcgacggcgagtaccgcctgcggggcgaggcccgcaagaccttcgtggacctgatgcggcgcggggacctccccgtgtggctggcctaccgggtcgcggccgagggcatcaactacgccgaccgccggtggtgcttcgacggggtgaagaacaaccagatcctggaggagaacgtcgaggtggagatctggaccaaggagggcgagcgcaagaagctcaagccgcggtggctggacgcccgcatctacagcgaccccctggccctcaaggagttcaaggagttcgcggccgggcggaagtccctgacgctgaacctcatcaccgagatgggccgcctgcccaccttcatgacccagaaggcccggaacgccctggacaacctcgcggtgctgcacacggccgaggccggcgggcgcgcctacaaccacgccctgagcgagctccccgagaccctggagaccctgctcctgctgaccctcctggcgaccgtcacgggcgggatcttcctgttcctcatgtccggcaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacgtacgtggtcatcgcgatcctcaccgtggtggccgccaccatggccaacgagatggggttcctggagaagaccaagaaggacttcggcctggggagcatcacgacccagcagccggagagcaacatcctcgacatcgacctgcgccccgcctccgcgtggaccctgtacgccgtcgccaccacgttcatcacccccatgctccggcacagcatcgagaactccagcgtgaacgtgtccctgaccgccatcgccaaccaggcgaccgtcctgatgggcctcggcaaggggtggcccctgagcaagatggacatcggcgtgccgctgctcgccatcgggtgctactcccaggtgaaccccatcacgctgaccgccgccctgctcctgctggtcgcgcactacgccatcatcggccccgggctccaggccaaggccacccgcgaggcccagaagcgggcggccgccggcatcatgaagaaccccaccgtggacggcatcacggtgatcgacctggacccgatcccctacgaccccaagttcgagaagcagctggggcaggtcatgctcctggtgctgtgcgtgacccaggtcctcatgatgcgcaccacctgggccctgtgcgaggccctgacgctcgcgaccggccccatcagcaccctgtgggaggggaacccgggccgcttctggaacaccacgatcgccgtgtccatggccaacatcttccgggggagctacctggccggcgccggcctcctgttctccatcatgaagaacaccgcgaacacccgccgggggaccggcaacacgggggagaccctgggcgagaagtggaagaaccgcctcaacgccctgggcaagagcgagttccagatctacaagaagtccgggatccaggaggtggaccggaccctggccaaggagggcatcaagcgcggggagaccgaccaccacgccgtcagccggggctccgcgaagctccgctggttcgtggagcggaacctggtgacgcccgaggggaaggtcgtggacctgggctgcggccgcgggggctggagctactactgcgggggcctcaagaacgtgaaggaggtcaaggggctgaccaagggcggccccgggcacgaggagcccatcccgatgtccacctacggctggaacctggtgcggctccagagcggggtggacgtcttcttcacgccgcccgagaagtgcgacaccctgctgtgcgacatcggcgagtccagccccaacccgacggtggaggccgggcgcaccctccgggtgctgaacctggtcgagaactggctcaacaacaacacccagttctgcatcaaggtgctgaacccctacatgcccagcgtgatcgagaagatggaggccctgcagcgcaagtacggcggcgccctggtccggaacccgctctcccgcaacagcacccacgagatgtactgggtgtccaacgccagcgggaacatcgtgtccagcgtcaacatgatctcccggatgctgatcaaccgcttcacgatgcggcacaagaaggcgacctacgagcccgacgtggacctgggcagcgggacccgcaacatcggcatcgagtccgagacccccaacctcgacatcatcgggaagcgcatcgagaagatcaagcaggagcacgagacgagctggcactacgaccaggaccacccctacaagacctgggcctaccacggctcctacgagaccaagcagaccggcagcgcctccagcatggtgaacggggtcgtgcggctgctgacgaagccgtgggacgtgatccccatggtcacccagatggccatgaccgacaccacgcccttcggccagcagcgcgtgttcaaggagaaggtggacacccggacccaggagcccaaggaggggaccaagaagctcatgaagatcacggccgagtggctgtggaaggagctgggcaagaagaagaccccgcgcatgtgcacccgggaggagttcacccgcaaggtccggtccaacgcggccctcggcgccatcttcacggacgagaacaagtggaagtccgcccgcgaggccgtggaggactccgggttctgggagctggtcgacaaggagcggaacctgcacctcgagggcaagtgcgagacctgcgtgtacaacatgatggggaagcgcgagaagaagctgggcgagttcgggaaggcgaagggcagccgggccatctggtacatgtggctgggcgcccgcttcctcgagttcgaggccctggggttcctgaacgaggaccactggttctcccgggagaacagcctcagcggcgtggagggggagggcctgcacaagctggggtacatcctccgcgacgtctccaagaaggagggcggcgcgatgtacgccgacgacaccgccgggtgggacacccggatcacgctggaggacctgaagaacgaggagatggtgaccaaccacatggagggcgagcacaagaagctcgccgaggccatcttcaagctgacctaccagaacaaggtggtccgcgtgcagcggcccacgccccgcgggacggtgatggacatcatcagccggcgcgaccagcggggctccgggcaggtcgtgacctacggcctgaacaccttcaccaacatggaggcgcagctcatccgccagatggagggcgagggggtgttcaagagcatccagcagctgacggtcaccgaggagatcgccgtgaagaactggctggtgaccgtcggccgcgagcggctctcccgcatggccatcagcggggacgactgcgtggtgaagcccctggacgaccggttcgcctccgccctgaccgcgctcaacgacatgggcaaggtccgcaaggacatccagcagtgggagccgagccggggctggaacgactggacccaggtgcccttctgctcccaccacttccacgagctgatcatgaaggacgggcgcgtgctggtcgtgccctgccggaaccaggacgagctcatcggccgcgcccggatcagccagggggccggctggtccctgcgcgagacggcctgcctgggcaagagctacgcccagatgtggtccctcatgtacttccaccggcgcgacctgcggctggcggccaacgccatctgcagcgccgtgccctcccactgggtcccgaccagccgcaccacctggtccatccacgccacgcacgagtggatgaccaccgaggacatgctcaccgtgtggaaccgggtgtggatccaggagaacccctggatggaggacaagacgcccgtcgagagctgggaggagatcccctacctgggcaagcgcgaggaccagtggtgcggcagcctgatcgggctcacctcccgggcgacctgggccaagaacatccagaccgccatcaaccaggtgcgcagcctgatcggcaacgaggagtacacggactacatgccgtccatgaagcggttccgccgcgaggaggaggaggccggggtgctgtggtga

SEQ ID NO: 9681 - RNA, 9876 nt, synthetic construct
  misc_feature 1..9876: note = derived and/or modified CDS sequence (opt1) from DENV-2__KC762675__SS-prME
  source 1..9876: mol_type = other RNA
accgccggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacccacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtctactgcgacagcaagctgatgtccgccgccatcaaggacaaccgggcggtgcacgccgacatggggtactggatcgagagcgccctcaacgacacctggaagatcgagaaggcctccttcatcgaggtcaagagctgctactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggccctgttcctcgaggagatgctgcgcacccgggtggggaccaagcacgcgatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgccctgctggccgcgttcaaggtgcggcccacgttcgccgccggcctcctgctgcgcaagctcacctccaaggagctgatgatgaccaccatcgggatcgtgctgctcagccagtccacgatccccgagaccatcctggagctgaccgacgccctcgccctgggcatgatggcgctgaagatcgtccggaacatggagaagtaccagctcgccgtgaccatcatggccatcctgtgcgtcccgaacgccgtgatcctgcagaacgcctggaaggtgagctgcacgaccctcgcggtcgtgtccgtgagccccctgctgctcacctccagccagcagaaggccgactggatccccctggccctgaccatcaaggggctcaaccccacggccatcttcctgaccaccctgtcccgcaccagcaagaagcggtcctggccgctcaacgaggcgatcatggccgtcggcatggtgagcatcctggcctccagcctgctcaagaacgacatccccatgacgggccccctggtggccgggggcctgctcaccgtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagacgctgaccatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacacgatgtggcacgtgacccgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacacgggcaccatcggggccgtgagcctggacttctcccccggcaccagcggctcccccatcgtggacaagaaggggaaggtcgtgggcctctacgggaacggcgtggtcacccggagcggcacgtacgtgtccgcgatcgcccagaccgagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggacgctgatcctggccccgacccgcgtcgtggccgccgagatggaggaggccctccgcggcctgcccatccggtaccagacccccgcgatccgcgccgagcacaccgggcgggagatcgtggacctgatgtgccacgccacgttcaccatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctccggaagaacggcaagaaggtgatccagctgagccgcaagacgttcgacttcgagtacatcaagacccggaccaacgactgggacttcgtcgtgaccacggacatctccgagatgggcgcgaacttcaaggccgagcgcgtgatcgacccccggcgctgcatgaagcccgtcatcctgaccgacggggaggagcgggtgatcctcgccggccccatgccggtgacccacagctccgccgcccagcgccgggggcgcgtcggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtggacgccatcgacggcgagtaccgcctgcgcggggaggcccgcaagacgttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctactccgaccccctggccctcaaggagttcaaggagttcgcggccggccgcaagagcctgaccctgaacctcatcaccgagatgggccgcctgcccacgttcatgacccagaaggcccggaacgccctggacaacctcgcggtcctgcacaccgccgaggccgggggccgcgcctacaaccacgccctgtccgagctccccgagaccctggagacgctgctcctgctgaccctcctggcgaccgtgaccgggggcatcttcctgttcctcatgagcggcaaggggatcggcaagatgaccctggggatgtgctgcatcatcacggcctccatcctgctctggtacgcccagatccagccgcactggatcgccgccagcatcatcctggagttcttcctgatcgtgctcctgatccccgagcccgagaagcagcggacgccccaggacaaccagctgacctacgtcgtgatcgcgatcctcaccgtggtcgccgccacgatggccaacgagatgggcttcctggagaagaccaagaaggacttcgggctgggctccatcaccacccagcagccggagagcaacatcctcgacatcgacctgcgccccgccagcgcgtggacgctgtacgccgtggccaccaccttcatcacccccatgctccggcactccatcgagaacagctccgtgaacgtcagcctgacggccatcgccaaccaggcgaccgtgctgatgggcctcgggaagggctggcccctgtccaagatggacatcggggtgccgctgctcgccatcggctgctacagccaggtcaaccccatcaccctgaccgccgccctgctcctgctggtggcgcactacgccatcatcgggcccggcctccaggccaaggccacgcgcgaggcccagaagcgggcggccgccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcgcacgacctgggccctgtgcgaggccctgaccctcgcgaccgggcccatctccacgctgtgggagggcaacccggggcgcttctggaacaccaccatcgccgtgagcatggccaacatcttccggggctcctacctggccggcgccgggctcctgttcagcatcatgaagaacaccgcgaacacgcgccggggcaccgggaacaccggcgagaccctgggcgagaagtggaagaaccgcctcaacgccctggggaagtccgagttccagatctacaagaagtccggcatccaggaggtcgaccggacgctggccaaggaggggatcaagcgcggcgagaccgaccaccacgccgtgtcccgggggagcgcgaagctccgctggttcgtggagcggaacctggtcacccccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacgtacgggtggaacctggtgcggctccagtccggcgtcgacgtgttcttcacgccgcccgagaagtgcgacaccctgctgtgcgacatcggggagagctcccccaacccgaccgtggaggccggccgcaccctccgggtcctgaacctggtggagaactggctcaacaacaacacgcagttctgcatcaaggtgctgaacccctacatgcccagcgtcatcgagaagatggaggccctgcagcgcaagtacggcggggccctggtgcggaacccgctcagccgcaactccacccacgagatgtactgggtgagcaacgcctccggcaacatcgtcagctccgtgaacatgatcagccggatgctgatcaaccgcttcaccatgcggcacaagaaggcgacctacgagcccgacgtggacctggggtccggcacgcgcaacatcgggatcgagagcgagatccccaacctcgacatcatcggcaagcgcatcgagaagatccagcaggagcacgagacctcctggcactacgaccaggaccacccctaccggacctgggcctaccacggcagctacgagaccaagcagacggggtccgccagctccatggtcaacggcgtggtgcgcctgctgaccaagccgtgggacgtcatccccatggtgacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgcagcaacgcggccctcggggccatcttcaccgacgagaacaagtggaagtccgcccgggaggccgtcgaggacagcggcttctgggagctggtggacaaggagcgcaacctgcacctcgaggggaagtgcgagacctgcgtgtacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaactccctcagcggggtcgagggcgaggggctgcacaagctgggctacatcctccgggacgtgagcaagaaggagggcggggcgatgtacgccgacgacaccgccggctgggacacgcgcatcaccctggaggacctgaagaaggaggagatggtgaccaaccacatggagggggagcacaagaagctcgccgaggccatcttcaagctgacctaccagaacaaggtcgtgcgggtgcagcgccccacgccccggggcaccgtcatggacatcatctcccgccgggaccagcgcgggagcggccaggtggtgacctacggcctgaacaccttcacgaacatggaggcgcagctcatccgccagatggagggggagggcgtcttcaagtccatccagcagctgaccgtgaccgaggagatcgccgtgaagaactggctggtccgggtggggcgcgagcggctcagccgcatggccatctccggcgacgactgcgtggtcaagcccctggacgaccggttcgccagcgccctgaccgcgctcaacgacatgggcaaggtgcgcaaggacatccagcagtgggagccgtcccgggggtggaacgactggacccaggtgcccttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtccccagccactgggtgccgacctcccgcaccacctggagcatccacgccacgcacgagtggatgaccaccgaggacatgctcaccgtgtggaaccgggtctggatccaggagaacccctggatggaggacaagacgcccgtggagtcctgggaggagatcccctacctgggcaagcgcgaggaccagtggtgcgggagcctgatcggcctcaccagccgggcgacctgggccaagaacatccagaccgccatcaaccaggtgcgctccctgatcgggaacgaggagtacacggactacatgccgagcatgaagcgcttccggcgcgaggaggaggaggccggcgtcctgtggtga

SEQ ID NO: 9682 - RNA, 9876 nt, synthetic construct
  misc_feature 1..9876: note = derived and/or modified CDS sequence (opt1) from DENV-2__KC762671__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacagccgggccgtgcacgccgacatggggtactggatcgagtccgccctcaacgacacgtggaagatcgagaaggccagcttcatcgaggtgaagtcctgccactggcccaagagccacaccctgtggtccaacggcgtcctggagagcgagatgatcatccccaagaacttcgcgggccccgtgagccagcacaactaccgcccggggtaccacacccagaccgccggcccctggcacctcgggcggctggagatggacttcgacttctgcgagggcaccacggtggtcgtgaccgaggactgcgggaaccgcggcccctccctgcggaccaccacggccagcggcaagctcatcaccgagtggtgctgccgctcctgcaccctgcccccgctgcggtaccgcggggaggacggctgctggtacgggatggagatccggcccctcaaggagaaggaggagaacctggtgaacagcctggtcaccgccggccacgggcagatcgacaacttctccctcggcgtgctgggcatggcgctgttcctcgaggagatgctgcgcacgcgggtggggaccaagcacgccatcctgctcgtcgccgtgagcttcgtgaccctgatcaccggcaacatgtccttccgcgacctggggcgcgtcatggtgatggtgggcgccacgatgaccgacgacatcgggatgggcgtcacctacctcgccctgctggcggccttcaaggtgcggcccaccttcgccgccggcctcctgctgcgcaagctcacgagcaaggagctgatgatgaccaccatcgggatcgtgctgctctcccaggccaccatccccgagacgatcctggagctgaccgacgcgctcgccctgggcatgatggtcctgaagatcgtgcggaacatggagaagtaccagctcgccgtcaccatcatggccatcctgtgcgtgccgaacgccgtgatcctgcagaacgcgtggaaggtcagctgcaccacgctcgccgtggtgtccgtcagccccctgctgctcacctccagccagcagaaggccgactggatccccctggccctgaccatcaaggggctcaaccccaccgcgatcttcctgacgaccctgtcccgcaccagcaagaagcggtcctggccgctcaacgaggccatcatggccgtgggcatggtgagcatcctggcctccagcctgctcaagaacgacatccccatgaccggccccctggtcgccgggggcctgctcacggtgtgctacgtgctgaccgggcgcagcgcggacctggagctcgagcgggccgccgacgtccgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtgtccatccccatcaccgccgcggcctggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgcgggcgtgtacaaggaggggaccttccacaccatgtggcacgtgacgcgcggcgccgtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggcggtgagcctggacttctcccccggcaccagcggctcccccatcgtcgacaagaaggggaaggtggtgggcctctacgggaacggcgtcgtgacccggagcggcacctacgtgtccgccatcgcccagacggagaagtccatcgaggacaaccccgagatcgaggacgacatcttccgcaagaagcggctgaccatcatggacctgcaccccggggccggcaagaccaagcgctacctgcccgcgatcgtccgggaggccatcaagcgcgggctccggaccctgatcctggccccgacgcgcgtggtggccgccgagatggaggaggcgctccgcggcctgcccatccggtaccagacccccgccatccgcgccgagcacaccgggcgggagatcgtcgacctgatgtgccacgccaccttcacgatgcgcctcctgagccccatccgggtgccgaactacaacctgatcatcatggacgaggcccacttcaccgaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgccgcgtgcctccggaagaacggcaagaaggtcatccagctgagccgcaagaccttcgacttcgagtacatcaagacgcggaccaacgactgggacttcgtggtgaccaccgacatctccgagatgggcgccaacttcaaggccgagcgcgtcatcgacccccggcgctgcatgaagcccgtgatcctgacggacggggaggagcgggtgatcctcgccggccccatgccggtcacccacagctccgccgcgcagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcgtaccgggtcgccgccgaggggatcaactacgccgaccgccggtggtgcttcgacggcgtgaagaacaaccagatcctggaggagaacgtggaggtcgagatctggacgaaggagggggagcgcaagaagctcaagccgcggtggctggacgcccgcatctactccgaccccctggcgctcaaggagttcaaggagttcgccgccggccgcaagagcctgaccctgaacctcatcaccgagatgggccgcctgcccaccttcatgacgcagaaggcccggaacgcgctggacaacctcgccgtgctgcacaccgccgaggccgggggccgcgcctacaaccacgcgctgtccgagctccccgagaccctggagaccctgctcctgctgacgctcctggccaccgtgaccgggggcatcttcctgttcctcatgagcggcaaggggatcggcaagatgaccctggggatgtgctgcatcatcaccgcctccatcctgctctggtacgcccagatccagccgcactggatcgccgcgagcatcatcctggagttcttcctgatcgtcctcctgatccccgagcccgagaagcagcggacgccccaggacaaccagctgacctacgtggtgatcgccatcctcaccgtcgtggccgccaccatggccaacgagatgggcttcctggagaagacgaagaaggacttcgggctgggctccatcaccacccagcagccggagagcaacatcctcgacatcgacctgcgccccgcgagcgcctggaccctgtacgccgtggccacgaccttcatcacccccatgctccggcactccatcgagaacagctccgtcaacgtgagcctgaccgccatcgcgaaccaggccacggtgctgatgggcctcgggaagggctggcccctgtccaagatggacatcggggtcccgctgctcgccatcggctgctacagccaggtgaaccccatcaccctgaccgccgcgctgctcctgctggtggcccactacgccatcatcgggcccggcctccaggccaaggccacccgcgaggcgcagaagcgggccgccgccggcatcatgaagaaccccacggtcgacgggatcaccgtgatcgacctggacccgatcccctacgaccccaagttcgagaagcagctgggccaggtgatgctcctggtcctgtgcgtgacccaggtgctcatgatgcgcaccacgtgggccctgtgcgaggcgctgaccctcgccaccgggcccatctccaccctgtgggagggcaacccggggcgcttctggaacacgaccatcgccgtcagcatggccaacatcttccggggctcctacctggccggcgcggggctcctgttcagcatcatgaagaacaccgccaacacccgccggggcacggggaacaccggcgagaccctgggcgagaagtggaagaaccgcctcaacgccctggggaagtccgagttccagatctacaagaagtccggcatccaggaggtggaccggaccctggccaaggaggggatcaagcgcggcgagacggaccaccacgcggtgtcccgggggagcgccaagctccgctggttcgtcgagcggaacctggtgacccccgagggcaaggtggtcgacctgggctgcgggcgcggcgggtggtcctactactgcggcgggctcaagaacgtgaaggaggtgaagggcctgaccaagggcgggcccggccacgaggagcccatcccgatgagcacctacgggtggaacctggtccggctccagtccggcgtggacgtgttcttcacgccgcccgagaagtgcgacaccctgctgtgcgacatcggggagagctcccccaacccgaccgtcgaggccggccgcaccctccgggtgctgaacctggtggagaactggctcaacaacaacacccagttctgcatcaaggtcctgaacccctacatgcccagcgtgatcgagaagatggaggccctgcagcgcaagtacggcggggccctggtgcggaacccgctcagccgcaactccacgcacgagatgtactgggtcagcaacgcgtccggcaacatcgtgagctccgtgaacatgatcagccggatgctgatcaaccgcttcaccatgcggcacaagaaggccacctacgagcccgacgtcgacctggggtccggcacccgcaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctgctgaccaagccgtgggacgtgatccccatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagaccccgcgcatgtgcacccgggaggagttcgcccgcaaggtccggagcaacgccgccctcggggccatcttcacggacgagaacaagtggaagtccgcgcgcgaggccgtggaggacagcggcttctgggagctggtggacaaggagcggaacctgcacctcgaggggaagtgcgagacctgcgtctacaacatgatgggcaagcgcgagaagaagctgggggagttcggcaaggccaagggctcccgggccatctggtacatgtggctgggggcgcgcttcctcgagttcgaggccctgggcttcctgaacgaggaccactggttcagccgggagaactccctcagcggggtggagggcgaggggctgcacaagctgggctacatcctccgcgacgtgagcatgaaggagggcggggccatgtacgccgacgacaccgccggctgggacacccggatcacgctggaggacctgaagaacgaggagatggtcaccaaccacatggagggggagcacaagaagctcgcggaggccatcttcaagctgacctaccagaacaaggtggtgcgcgtccagcggcccacgccccggggcacggtgatggacatcatctcccggcgcgaccagcgggggagcggccaggtggtcacctacggcctgaacaccttcaccaacatggaggcccagctcatccgccagatggagggggagggcgtgttcaagtccatccagcagctgacggtgaccgaggagatcgccgtcaagaactggctggtgcgcgtggggcgggagcgcctcagccggatggccatctccggcgacgactgcgtcgtgaagcccctggacgaccgcttcgcgagcgccctgaccgccctcaacgacatgggcaaggtgcggaaggacatccagcagtgggagccgtcccgcgggtggaacgactggacccaggtccccttctgcagccaccacttccacgagctgatcatgaaggacggccgggtgctggtggtcccctgccgcaaccaggacgagctcatcgggcgggcccgcatctcccagggcgccgggtggagcctgcgggagacggcgtgcctgggcaagtcctacgcccagatgtggagcctcatgtacttccaccgccgggacctgcgcctggccgccaacgccatctgctccgcggtgcccagccactgggtgccgacctcccggaccacctggagcatccacgccacccacgagtggatgacgaccgaggacatgctcaccgtctggaaccgcgtgtggatccaggagaacccctggatggaggacaagacccccgtggagtcctgggaggagatcccctacctgggcaagcgggaggaccagtggtgcgggagcctgatcggcctcacgagccgcgccacctgggccaagaacatccagaccgcgatcaaccaggtccggtccctgatcgggaacgaggagtacaccgactacatgccgagcatgaagcgcttccgccgggaggaggaggaggccggcgtgctgtggtga

SEQ ID NO: 9683 - RNA, 9876 nt, synthetic construct
  misc_feature 1..9876: note = derived and/or modified CDS sequence (opt1) from DENV-2__KC762664__SS-prME
  source 1..9876: mol_type = other RNA
accgccggcatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcaccgacctggagaagcggcacggcctggggcgcctcatcaccgtcaacccgatcgtgaccgagaaggactcccccgtgaacatcgaggcggagccgcccttcggcgacagctacatcatcatcggggtcgagccgggccagctgaagctgtcctggttcaagaaggggagctccatcggccagatgttcgagacgaccatgcgcggcgccaagcggatggccatcctcggggacaccgcctgggacttcggcagcctcggcggggtgttcacctccatcgggaaggccctgcaccaggtgttcggggcgatctacggcgccgccttcagcggggtctcctggacgatgaagatcctcatcggcgtggtgatcacctggatcgggatgaacagccgctccaccagcctgtccgtcagcctggtgctggtgggcgtcgtgaccctctacctgggggtgatggtccaggccgactccggctgcgtggtgagctggaagaacaaggagctgaagtgcggcagcgggatcttcatcacggacaacgtccacacctggaccgagcagtacaagttccagcccgagtcccccagcaagctcgcgtccgccatccagaaggcccacgaggagggcatctgcgggatccggagcgtgacccgcctggagaacctgatgtggaagcagatcacgcccgagctcaaccacatcctgtccgagaacgaggtgaagctgaccatcatgaccggcgacatcaaggggatcatgcaggccggcaagcggagcctccgcccgcagcccaccgagctgaagtactcctggaagacgtggggcaaggccaagatgctgagcaccgagctccacaaccacaccttcctgatcgacgggcccgagaccgcggagtgcccgaacgccaaccgggcctggaactccctggaggtcgaggactacggcttcggggtgttcacgaccaacatctggctcaagctgaaggagcgccaggacgccttctgcgacagcaagctgatgtccgccgcgatcaaggacaaccgggccgtgcacgccgacatgggctactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcggggcccgtgagccagcacaactaccgcccgggctaccacacccagacggccgggccctggcacctcggccggctggagatggacttcgacttctgcgaggggaccaccgtcgtggtgaccgaggactgcggcaaccgcggccccagcctgcggacgaccaccgcctccgggaagctcatcaccgagtggtgctgccgcagctgcacgctgcccccgctgcggtaccgcggcgaggacgggtgctggtacggcatggagatccggcccctcaaggagaaggaggagaacctggtcaactccctggtgaccgccgggcacggccagatcgacaacttcagcctcggcgtgctggggatggcgctgttcctcgaggagatgctgcgcacccgggtcggcaccaagcacgccatcctgctcgtggccgtgtccttcgtcacgctgatcaccgggaacatgagcttccgcgacctgggccgcgtgatggtgatggtcggggccaccatgaccgacgacatcggcatgggcgtgacgtacctcgccctgctggcggccttcaaggtgcggcccaccttcgccgccgggctcctgctgcgcaagctcacctccaaggagctgatgatgaccacgatcggcatcaccctgctcagccagtccaccatccccgagaccatcctggagctgacggacgccctcgcgctggggatgatggtcctgaagatcgtgcggaacatggagaagtaccagctcgccgtgaccatcatggccatcctgtgcgtcccgaacgccgtgatcctgcagaacgcctggaaggtcagctgcaccaccctcgcggtggtgtccgtcagccccctgctgctcacgtccagccagcagaaggccgactggatccccctggccctgaccatcaagggcctcaaccccaccgccatcttcctgaccacgctgtcccgcaccagcaagaagcggtcctggccgctcaacgaggcgatcatggccgtgggcatggtgagcatcctggcctccagcctgctcaagaacgacatccccatgaccgggcccctggtcgccggcgggctgctcaccgtgtgctacgtgctgacgggccgcagcgccgacctggagctcgagcgggcggccgacgtccgctgggaggagcaggccgagatctccgggagctcccccatcctgagcatcaccatctccgaggacggcagcatgtccatcaagaacgaggaggaggagcagaccctgaccatcctcatccggaccggcctgctggtgatcagcgggctgttcccggtgtccatccccatcacggccgccgcgtggtacctgtgggaggtcaagaagcagcgcgccggcgtgctgtgggacgtgcccagcccgccgcccgtcgagaaggccgagctcgaggacggggcctaccggatcaagcagaagggcatcctggggtactcccagatcggcgccggcgtgtacaaggaggggaccttccacaccatgtggcacgtgacccgcggcgcggtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagacgaagcccgggctgttcaagaccagcaccggcaccatcggggccgtgtccctggacttcagccccggcacgtccggcagccccatcgtcgacaagaaggggaaggtggtgggcctctacgggaacggcgtcgtgacccggtccggcacctacgtgagcgcgatcgcccagaccgagaagtccatcgaggacaaccccgagatcgaggacgacatcttccgcaagaagcggctgacgatcatggacctgcaccccggggccggcaagaccaagcgctacctgcccgccatcgtccgggaggcgatcaagcgcgggctccggaccctgatcctggccccgacccgcgtggtggccgccgagatggaggaggccctccgcggcctgcccatccggtaccagacgcccgcgatccgcgccgagcacaccgggcgggagatcgtcgacctgatgtgccacgccaccttcaccatgcgcctcctgtcccccatccgggtgccgaactacaacctgatcatcatggacgaggcccacttcacggaccccgccagcatcgcggcccgcggctacatctccacccgggtggagatgggcaaggccgccgggatcttcatgaccgccacgccgcccggcagccgcgacccgttcccccagtccaacgcgcccatcatggacgaggagcgggagatccccgagcgcagctggaactccgggcacgagtgggtcacggacttcaagggcaagaccgtgtggttcgtgccgagcatcaaggccgggaacgacatcgccgcctgcctccggaagaacggcaagaaggtcatccagctgtcccgcaagaccttcgacttcgagtacatcaagacccggacgaacgactgggacttcgtggtgaccaccgacatcagcgagatgggcgcgaacttcaaggccgagcgcgtcatcgacccccggcgctgcatgaagcccgtgatcctgaccgacggggaggagcgggtgatcctcgccggccccatgccggtcacgcactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtcgacctgatgcggcgcggcgacctccccgtgtggctggcctaccgggtggcggccgaggggatcaactacgccgaccgccggtggtgcttcgacggcgtcaagaacaaccagatcctggaggagaacgtggaggtcgagatctggaccaaggagggggagcgcaagaagctcaagccgcggtggctggacgcccgcatctacagcgaccccctggccctcaaggagttcaaggagttcgcggccggccggaagtccctgacgctgaacctcatcaccgagatgggccgcctgcccaccttcatgacccagaaggcccggaacgccctggacaacctcgcggtgctgcacacggccgaggccgggggccgcgcctacaaccacgccctgagcgagctccccgagaccctggagaccctgctcctgctgaccctcctggcgaccgtgaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtcctcctgatccccgagcccgagaagcagcggacgccccaggacaaccagctgacgtacgtggtgatcgcgatcctcaccgtcgtggccgccaccatggccaacgagatgggcttcctggagaagaccaagaaggacttcgggctgggcagcatcacgacccagcagccggagagcaacatcctcgacatcgacctgcgccccgcctccgcgtggaccctgtacgccgtggccaccacgttcatcacccccatgctccggcacagcatcgagaactccagcgtcaacgtgtccctgaccgccatcgccaaccaggcgaccgtgctgatgggcctcgggaagggctggcccctgagcaagatggacatcggggtcccgctgctcgccatcggctgctactcccaggtgaaccccatcacgctgaccgccgccctgctcctgctggtggcgcactacgccatcatcgggcccggcctccaggccaaggccacccgcgaggcccagaagcgggcggccgccggcatcatgaagaaccccaccgtcgacgggatcacggtgatcgacctggacccgatcccctacgaccccaagttcgagaagcagctgggccaggtgatgctcctggtcctgtgcgtgacccaggtgctcatgatgcgcaccacctgggccctgtgcgaggccctgacgctcgcgaccgggcccatcagcaccctgtgggagggcaacccggggcgcttctggaacaccacgatcgccgtctccatggccaacatcttccggggcagctacctggccggcgccgggctcctgttctccatcatgaagaacaccgcgaacacccgccggggcaccgggaacacgggcgagaccctgggcgagaagtggaagaaccgcctcaacgccctgggcaagagcgagttccagatctacaagaagtccggcatccaggaggtggaccggaccctggccaaggaggggatcaagcgcggcgagaccgaccaccacgccgtgagccgggggtccgcgaagctccgctggttcgtcgagcggaacctggtgacgcccgagggcaaggtggtcgacctgggctgcgggcgcggcgggtggagctactactgcggcgggctcaagaacgtgaaggaggtgaagggcctgaccaagggcgggcccggccacgaggagcccatcccgatgtccacctacgggtggaacctggtccggctccagagcggcgtggacgtgttcttcacgccgcccgagaagtgcgacaccctgctgtgcgacatcggggagtccagccccaacccgacggtcgaggccggccgcaccctccgggtgctgaacctggtggagaactggctcaacaacaacacccagttctgcatcaaggtcctgaacccctacatgcccagcgtgatcgagaagatggaggccctgcagcgcaagtacggcggggccctggtgcggaacccgctctcccgcaacagcacccacgagatgtactgggtctccaacgccagcggcaacatcgtgtccagcgtgaacatgatctcccggatgctgatcaaccgcttcacgatgcggcacaagaaggcgacctacgagcccgacgtcgacctggggagcggcacccgcaacatcgggatcgagtccgagacccccaacctcgacatcatcggcaagcgcatcgagaagatcaagcaggagcacgagacgagctggcactacgaccaggaccacccctacaagacctgggcctaccacggctcctacgagaccaagcagaccgggagcgcctccagcatggtgaacggcgtggtccggctgctgacgaagccgtgggacgtgatccccatggtgacccagatggccatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagaccccgcgcatgtgcacccgggaggagttcacccgcaaggtgcggtccaacgcggccctcggggccatcttcacggacgagaacaagtggaagtccgcccgcgaggccgtcgaggactccggcttctgggagctggtggacaaggagcggaacctgcacctcgaggggaagtgcgagacctgcgtctacaacatgatgggcaagcgcgagaagaagctgggggagttcggcaaggcgaagggcagccgggccatctggtacatgtggctgggggcccgcttcctcgagttcgaggccctgggcttcctgaacgaggaccactggttctcccgggagaacagcctcagcggggtggagggcgaggggctgcacaagctgggctacatcctccgcgacgtgtccaagaaggagggcggggcgatgtacgccgacgacaccgccggctgggacacccggatcacgctggaggacctgaagaacgaggagatggtcaccaaccacatggagggggagcacaagaagctcgccgaggccatcttcaagctgacctaccagaacaaggtggtgcgcgtccagcggcccacgccccggggcacggtgatggacatcatcagccggcgcgaccagcgggggtccggccaggtggtcacctacggcctgaacaccttcaccaacatggaggcgcagctcatccgccagatggagggggagggcgtgttcaagagcatccagcagctgacggtgaccgaggagatcgccgtcaagaactggctggtgaccgtggggcgcgagcggctctcccgcatggccatcagcggcgacgactgcgtcgtgaagcccctggacgaccggttcgcctccgccctgaccgcgctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagacggcctgcctgggcaagagctacgcccagatgtggtccctcatgtacttccaccggcgcgacctgcggctggcggccaacgccatctgcagcgccgtgccctcccactgggtgccgaccagccgcaccacctggtccatccacgccacgcacgagtggatgaccaccgaggacatgctcaccgtctggaaccgggtgtggatccaggagaacccctggatggaggacaagacgcccgtgggcagctgggaggagatcccctacctggggaagcgcgaggaccagtggtgcggcagcctgatcgggctcacctcccgggcgacctgggccaagaacatccagaccgccatcaaccaggtccgcagcctgatcggcaacgaggagtacacggactacatgccgtccatgaagcggttccgccgcgaggaggaggaggccggggtgctgtggtga

SEQ ID NO: 9684 - RNA, 9876 nt, synthetic construct
  misc_feature 1..9876: note = derived and/or modified CDS sequence (opt1) from DENV-2__KC762674__SS-prME
  source 1..9876: mol_type = other RNA
accgccggcatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacccacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtctactgcgacagcaagctgatgtccgccgccatcaaggacaaccgggcggtgcacgccgacatggggtactggatcgagagcgccctcaacgacacctggaagatcgagaaggcctccttcatcgaggtcaagagctgctactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggccctgttcctcgaggagatgctgcgcacccgggtggggaccaagcacgcgatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgccctgctggccgcgttcaaggtgcggcccacgttcgccgccggcctcctgctgcgcaagctcacctccaaggagctgatgatgaccaccatcgggatcgtgctgctcagccagtccacgatccccgagaccatcctggagctgaccgacgccctcgccctgggcatgatggcgctgaagatcgtccggaacatggagaagtaccagctcgccgtgaccatcatggccatcctgtgcgtcccgaacgccgtgatcctgcagaacgcctggaaggtgagctgcacgaccctcgcggtcgtgtccgtgagccccctgctgctcacctccagccagcagaaggccgactggatccccctggccctgaccatcaaggggctcaaccccacggccatcttcctgaccaccctgtcccgcaccagcaagaagcggtcctggccgctcaacgaggcgatcatggccgtcggcatggtgagcatcctggcctccagcctgctcaagaacgacatccccatgacgggccccctggtggccgggggcctgctcaccgtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagacgctgaccatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacacgatgtggcacgtgacccgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacacgggcaccatcggggccgtgagcctggacttctcccccggcaccagcggctcccccatcgtggacaagaaggggaaggtcgtgggcctctacgggaacggcgtggtcacccggagcggcacgtacgtgtccgcgatcgcccagaccgagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggacgctgatcctggccccgacccgcgtcgtggccgccgagatggaggaggccctccgcggcctgcccatccggtaccagacccccgcgatccgcgccgagcacaccgggcgggagatcgtggacctgatgtgccacgccacgttcaccatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctccggaagaacggcaagaaggtgatccagctgagccgcaagacgttcgacttcgagtacatcaagacccggaccaacgactgggacttcgtcgtgaccacggacatctccgagatgggcgcgaacttcaaggccgagcgcgtgatcgacccccggcgctgcatgaagcccgtcatcctgaccgacggggaggagcgggtgatcctcgccggccccatgccggtgacccacagctccgccgcccagcgccgggggcgcgtcggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtggacgccatcgacggcgagtaccgcctgcgcggggaggcccgcaagacgttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctactccgaccccctggccctcaaggagttcaaggagttcgcggccggccgcaagagcctgaccctgaacctcatcaccgagatgggccgcctgcccacgttcatgacccagaaggcccggaacgccctggacaacctcgcggtcctgcacaccgccgaggccgggggccgcgcctacaaccacgccctgtccgagctccccgagaccctggagacgctgctcctgctgaccctcctggcgaccgtgaccgggggcatcttcctgttcctcatgagcggcaaggggatcggcaagatgaccctggggatgtgctgcatcatcacggcctccatcctgctctggtacgcccagatccagccgcactggatcgccgccagcatcatcctggagttcttcctgatcgtgctcctgatccccgagcccgagaagcagcggacgccccaggacaaccagctgacctacgtcgtgatcgcgatcctcaccgtggtcgccgccacgatggccaacgagatgggcttcctggagaagaccaagaaggacttcgggctgggctccatcaccacccagcagccggagagcaacatcctcgacatcgacctgcgccccgccagcgcgtggacgctgtacgccgtggccaccaccttcatcacccccatgctccggcactccatcgagaacagctccgtgaacgtcagcctgacggccatcgccaaccaggcgaccgtgctgatgggcctcgggaagggctggcccctgtccaagatggacatcggggtgccgctgctcgccatcggctgctacagccaggtcaaccccatcaccctgaccgccgccctgctcctgctggtggcgcactacgccatcatcgggcccggcctccaggccaaggccacgcgcgaggcccagaagcgggcggccgccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcgcacgacctgggccctgtgcgaggccctgaccctcgcgaccgggcccatctccacgctgtgggagggcaacccggggcgcttctggaacaccaccatcgccgtgagcatggccaacatcttccggggctcctacctggccggcgccgggctcctgttcagcatcatgaagaacaccgcgaacacgcgccggggcaccgggaacaccggcgagaccctgggcgagaagtggaagaaccgcctcaacgccctggggaagtccgagttccagatctacaagaagtccggcatccaggaggtcgaccggacgctggccaaggaggggatcaagcgcggcgagaccgaccaccacgccgtgtcccgggggagcgcgaagctccgctggttcgtggagcggaacctggtcacccccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacgtacgggtggaacctggtgcggctccagtccggcgtcgacgtgttcttcacgccgcccgagaagtgcgacaccctgctgtgcgacatcggggagagctcccccaacccgaccgtggaggccggccgcaccctccgggtcctgaacctggtggagaactggctcaacaacaacacgcagttctgcatcaaggtgctgaacccctacatgcccagcgtcatcgagaagatggaggccctgcagcgcaagtacggcggggccctggtgcggaacccgctcagccgcaactccacccacgagatgtactgggtgagcaacgcctccggcaacatcgtcagctccgtgaacatgatcagccggatgctgatcaaccgcttcaccatgcggcacaagaaggcgacctacgagcccgacgtggacctggggtccggcacgcgcaacatcgggatcgagagcgagatccccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtcaacggcgtggtgcggctgctgaccaagccgtgggacgtcatccccatggtgacccagatggccatgaccgacacgacccccttcgggcagcagcgcgtgttcaaggagaaggtcgacacccggacccaggagcccaaggagggcacgaagaagctcatgaagatcaccgccgagtggctgtggaaggagctgggcaagaagaagaccccgcgcatgtgcacccgggaggagttcacgcgcaaggtgcggagcaacgcggccctcggggccatcttcaccgacgagaacaagtggaagtccgcccgcgaggccgtcgaggacagcggcttctgggagctggtggacaaggagcggaacctgcacctcgaggggaagtgcgagacctgcgtgtacaacatgatgggcaagcgcgagaagaagctgggggagttcggcaaggcgaagggctcccgggccatctggtacatgtggctgggggcccgcttcctcgagttcgaggccctgggcttcctgaacgaggaccactggttcagccgggagaactccctcagcggggtcgagggcgaggggctgcacaagctgggctacatcctccgcgacgtgagcaagaaggagggcggggcgatgtacgccgacgacaccgccggctgggacacgcggatcaccctggaggacctgaagaacgaggagatggtgaccaaccacatggagggggagcacaagaagctcgccgaggccatcttcaagctgacctaccagaacaaggtcgtgcgcgtgcagcggcccacgccccgcggcaccgtcatggacatcatctcccggcgcgaccagcgggggagcggccaggtggtgacctacggcctgaacaccttcacgaacatggaggcgcagctcatccgccagatggagggggagggcgtcttcaagtccatccagcagctgaccgtgaccgaggagatcgccgtgaagaactggctggtccgcgtggggcgggagcgcctcagccggatggccatctccggcgacgactgcgtggtcaagcccctggacgaccgcttcgccagcgccctgaccgcgctcaacgacatgggcaaggtgcggaaggacatccagcagtgggagccgtcccgcgggtggaacgactggacccaggtgcccttctgcagccaccacttccacgagctgatcatgaaggacggccgggtcctggtggtgccctgccgcaaccaggacgagctcatcgggcgggcccgcatctcccagggcgccgggtggagcctgcgggagaccgcctgcctgggcaagtcctacgcccagatgtggagcctcatgtacttccaccgccgggacctgcgcctggcggccaacgccatctgctccgccgtccccagccactgggtgccgacctcccggaccacctggagcatccacgccacgcacgagtggatgaccaccgaggacatgctcaccgtgtggaaccgcgtctggatccaggagaacccctggatggaggacaagacgcccgtggagtcctgggaggagatcccctacctgggcaagcgggaggaccagtggtgcgggagcctgatcggcctcaccagccgcgcgacctgggccaagaacatccagaccgccatcaaccaggtgcggtccctgatcgggaacgaggagtacacggactacatgccgagcatgaagcgcttccgccgggaggaggaggaggccggcgtcctgtggtga

SEQ ID NO: 9685 - RNA, 9876 nt, synthetic construct
  misc_feature 1..9876: note = derived and/or modified CDS sequence (opt1) from DENV-2__KC762672__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctgggagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacagccgggccgtgcacgccgacatggggtactggatcgagtccgccctcaacgacacgtggaagatcgagaaggccagcttcatcgaggtgaagtcctgccactggcccaagagccacaccctgtggtccaacggcgtcctggagagcgagatgatcatccccaagaacttcgcgggccccgtgagccagcacaactaccgcccggggtaccacacccagaccgccggcccctggcacctcgggcggctggagatggacttcgacttctgcgagggcaccacggtggtcgtgaccgaggactgcgggaaccgcggcccctccctgcggaccaccacggccagcggcaagctcatcaccgagtggtgctgccgctcctgcaccctgcccccgctgcggtaccgcggggaggacggctgctggtacgggatggagatccggcccctcaaggagaaggaggagaacctggtgaacagcctggtcaccgccggccacgggcagatcgacaacttctccctcggcgtgctgggcatggcgctgttcctcgaggagatgctgcgcacgcgggtggggaccaagcacgccatcctgctcgtcgccgtgagcttcgtgaccctgatcaccggcaacatgtccttccgcgacctggggcgcgtcatggtgatggtgggcgccacgatgaccgacgacatcgggatgggcgtcacctacctcgccctgctggcggccttcaaggtgcggcccaccttcgccgccggcctcctgctgcgcaagctcacgagcaaggagctgatgatgaccaccatcgggatcgtgctgctctcccaggccaccatccccgagacgatcctggagctgaccgacgcgctcgccctgggcatgatggtcctgaagatcgtgcggaacatggagaagtaccagctcgccgtcaccatcatggccatcctgtgcgtgccgaacgccgtgatcctgcagaacgcgtggaaggtcagctgcaccacgctcgccgtggtgtccgtcagccccctgctgctcacctccagccagcagaaggccgactggatccccctggccctgaccatcaaggggctcaaccccaccgcgatcttcctgacgaccctgtcccgcaccagcaagaagcggtcctggccgctcaacgaggccatcatggccgtgggcatggtgagcatcctggcctccagcctgctcaagaacgacatccccatgaccggccccctggtcgccgggggcctgctcacggtgtgctacgtgctgaccgggcgcagcgcggacctggagctcgagcgggccgccgacgtccgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtgtccatccccatcaccgccgcggcctggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgcgggcgtgtacaaggaggggaccttccacaccatgtggcacgtgacgcgcggcgccgtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggcggtgagcctggacttctcccccggcaccagcggctcccccatcgtcgacaagaaggggaaggtggtgggcctctacgggaacggcgtcgtgacccggagcggcacctacgtgtccgccatcgcccagacggagaagtccatcgaggacaaccccgagatcgaggacgacatcttccgcaagaagcggctgaccatcatggacctgcaccccggggccggcaagaccaagcgctacctgcccgcgatcgtccgggaggccatcaagcgcgggctccggaccctgatcctggccccgacgcgcgtggtggccgccgagatggaggaggcgctccgcggcctgcccatccggtaccagacccccgccatccgcgccgagcacaccgggcgggagatcgtcgacctgatgtgccacgccaccttcacgatgcgcctcctgagccccatccgggtgccgaactacaacctgatcatcatggacgaggcccacttcaccgaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgccgcgtgcctccggaagaacggcaagaaggtcatccagctgagccgcaagaccttcgacttcgagtacatcaagacgcggaccaacgactgggacttcgtggtgaccaccgacatctccgagatgggcgccaacttcaaggccgagcgcgtcatcgacccccggcgctgcatgaagcccgtgatcctgacggacggggaggagcgggtgatcctcgccggccccatgccggtcacccacagctccgccgcgcagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcgtaccgggtcgccgccgaggggatcaactacgccgaccgccggtggtgcttcgacggcgtgaagaacaaccagatcctggaggagaacgtggaggtcgagatctggacgaaggagggggagcgcaagaagctcaagccgcggtggctggacgcccgcatctactccgaccccctggcgctcaaggagttcaaggagttcgccgccggccgcaagagcctgaccctgaacctcatcaccgagatgggccgcctgcccaccttcatgacgcagaaggcccggaacgcgctggacaacctcgccgtgctgcacaccgccgaggccgggggccgcgcctacaaccacgcgctgtccgagctccccgagaccctggagaccctgctcctgctgacgctcctggccaccgtgaccgggggcatcttcctgttcctcatgagcggcaaggggatcggcaagatgaccctggggatgtgctgcatcatcaccgcctccatcctgctctggtacgcccagatccagccgcactggatcgccgcgagcatcatcctggagttcttcctgatcgtcctcctgatccccgagcccgagaagcagcggacgccccaggacaaccagctgacctacgtggtgatcgccatcctcaccgtcgtggccgccaccatggccaacgagatgggcttcctggagaagacgaagaaggacttcgggctgggctccatcaccacccagcagccggagagcaacatcctcgacatcgacctgcgccccgcgagcgcctggaccctgtacgccgtggccacgaccttcatcacccccatgctccggcactccatcgagaacagctccgtcaacgtgagcctgaccgccatcgcgaaccaggccacggtgctgatgggcctcgggaagggctggcccctgtccaagatggacatcggggtcccgctgctcgccatcggctgctacagccaggtgaaccccatcaccctgaccgccgcgctgctcctgctggtggcccactacgccatcatcgggcccggcctccaggccaaggccacccgcgaggcgcagaagcgggccgccgccggcatcatgaagaaccccacggtcgacgggatcaccgtgatcgacctggacccgatcccctacgaccccaagttcgagaagcagctgggccaggtgatgctcctggtcctgtgcgtgacccaggtgctcatgatgcgcaccacgtgggccctgtgcgaggcgctgaccctcgccaccgggcccatctccaccctgtgggagggcaacccggggcgcttctggaacacgaccatcgccgtcagcatggccaacatcttccggggctcctacctggccggcgcggggctcctgttcagcatcatgaagaacaccgccaacacccgccggggcacggggaacgccggcgagaccctgggcgagaagtggaagaaccgcctcaacgccctggggaagtccgagttccagatctacaagaagtccggcatccaggaggtggaccggaccctggcgaaggaggggatcaagcgcggcgagaccgaccaccacgccgtgtcccgggggagcgccaagctccgctggttcgtcgagcggaacctggtgacgcccgagggcaaggtggtcgacctgggctgcgggcgcggcgggtggtcctactactgcggcgggctcaagaacgtgaaggaggtgaagggcctgaccaagggcgggcccggccacgaggagcccatcccgatgagcacctacgggtggaacctggtccggctccagtccggcgtggacgtgttcttcacgccgcccgagaagtgcgacacgctgctgtgcgacatcggggagagctcccccaacccgaccgtcgaggccggccgcaccctccgggtgctgaacctggtggagaactggctcaacaacaacacccagttctgcatcaaggtcctgaacccctacatgcccagcgtgatcgagaagatggaggccctgcagcgcaagtacggcggggcgctggtgcggaacccgctcagccgcaactccacccacgagatgtactgggtcagcaacgcctccggcaacatcgtgagctccgtgaacatgatcagccggatgctgatcaaccgcttcacgatgcggcacaagaaggccacctacgagcccgacgtcgacctggggtccggcacccgcaacatcgggatcgagagcgagacccccaacctcgacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtggtccggctgctgacgaagccgtgggacgtgatccccatggtgacccagatggcgatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagaccccgcgcatgtgcacccgggaggagttcgcccgcaaggtccggagcaacgccgccctcggggcgatcttcaccgacgagaacaagtggaagtccgcccgcgaggccgtggaggacagcggcttctgggagctggtggacaaggagcggaacctgcacctcgaggggaagtgcgagacgtgcgtctacaacatgatgggcaagcgcgagaagaagctgggggagttcggcaaggccaagggctcccgggcgatctggtacatgtggctgggggcccgcttcctcgagttcgaggccctgggcttcctgaacgaggaccactggttcagccgggagaactccctcagcggggtggagggcgaggggctgcacaagctgggctacatcctccgcgacgtgagcatgaaggagggcggggccatgtacgccgacgacaccgcgggctgggacacccggatcaccctggaggacctgaagaacgaggagatggtcacgaaccacatggagggggagcacaagaagctcgccgaggccatcttcaagctgacctaccagaacaaggtggtgcgcgtccagcggcccacgccccggggcaccgtgatggacatcatctcccggcgcgaccagcgggggagcggccaggtggtcacgtacggcctgaacaccttcaccaacatggaggcccagctcatccgccagatggagggggagggcgtgttcaagtccatccagcagctgaccgtgacggaggagatcgccgtcaagaactggctggtgcgcgtggggcgggagcgcctcagccggatggcgatctccggcgacgactgcgtcgtgaagcccctggacgaccgcttcgccagcgccctgaccgccctcaacgacatgggcaaggtgcggaaggacatccagcagtgggagccgtcccgcgggtggaacgactggacccaggtccccttctgcagccaccacttccacgagctgatcatgaaggacggccgggtgctggtggtcccctgccgcaaccaggacgagctcatcgggcgggcccgcatctcccagggcgcggggtggagcctgcgggagaccgcctgcctgggcaagtcctacgcccagatgtggagcctcatgtacttccaccgccgggacctgcgcctggccgccaacgcgatctgctccgccgtgcccagccactgggtgccgacgtcccggaccacctggagcatccacgccacccacgagtggatgaccacggaggacatgctcaccgtctggaaccgcgtgtggatccaggagaacccctggatggaggacaagacccccgtggagtcctgggaggagatcccctacctgggcaagcgggaggaccagtggtgcgggagcctgatcggcctcaccagccgcgccacgtgggcgaagaacatccagaccgccatcaaccaggtccggtccctgatcgggaacgaggagtacaccgactacatgccgagcatgaagcgcttccgccgggaggaggaggaggccggcgtgctgtggtga

SEQ ID NO: 9686 - RNA, 9876 nt, synthetic construct
  misc_feature 1..9876: note = derived and/or modified CDS sequence (opt1) from DENV-2__KC762667__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggccctgcaccaggtcttcggggcgatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggccgactccgggtgcgtggtcagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacgccaaccgggcctggaactccctggaggtggaggactacgggttcggcgtgttcaccacgaacatctggctcaagctgaaggagcgccaggacgccttctgcgacagcaagctgatgtccgccgcgatcaaggacaaccgggccgtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtggtggtcaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgacggccggccacgggcagatcgacaacttcagcctcggcgtcctgggcatggcgctgttcctcgaggagatgctgcgcacccgggtggggaccaagcacgccatcctgctcgtggccgtctccttcgtgaccctgatcacgggcaacatgagcttccgcgacctggggcgcgtgatggtcatggtgggcgccaccatgaccgacgacatcgggatgggcgtgacctacctcgccctgctggcggccttcaaggtccggcccacgttcgccgccggcctcctgctgcgcaagctcacctccaaggagctgatgatgaccaccatcggggtgacgctgctcagccagtccaccatccccgagaccatcctggagctgaccgacgccctcgcgctgggcatgatggtgctgaagatcgtccggaacatggagaagtaccagctcgccgtgacgatcatggccatcctgtgcgtcccgaacgccgtgatcctgcagaacgcctggaaggtgagctgcaccaccctcgcggtcgtgtccgtgagccccctgctgctcacctccagccagcagaaggccgactggatccccctggccctgacgatcaaggggctcaaccccaccgccatcttcctgaccaccctgtcccgcacgagcaagaagcggtcctggccgctcaacgaggcgatcatggccgtcggcatggtgagcatcctggcctccagcctgctcaagaacgacatccccatgaccggccccctggtggccgggggcctgctcaccgtctgctacgtgctgaccgggcgcagcgccgacctggagctcgagcgggcggccgacgtgcgctgggaggagcaggccgagatctccggcagctcccccatcctgagcatcacgatctccgaggacgggagcatgtccatcaagaacgaggaggaggagcagaccctgaccatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggacgttccacaccatgtggcacgtgacccgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagacgagcaccggcaccatcggggccgtgtccctggacttcagccccggcacctccggcagccccatcgtggacaagaaggggaaggtcgtgggcctctacgggaacggcgtggtcacgcggtccggcacctacgtgagcgcgatcgcccagaccgagaagtccatcgaggacaaccccgagatcgaggacgacatcttccgcaagaagcggctgaccatcatggacctgcaccccggggccggcaagacgaagcgctacctgcccgccatcgtgcgggaggcgatcaagcgcgggctccggaccctgatcctggccccgacccgcgtcgtggccgccgagatggaggaggccctccgcggcctgcccatccggtaccagacccccgcgatccgcgccgagcacacggggcgggagatcgtggacctgatgtgccacgccaccttcaccatgcgcctcctgtcccccatccgggtcccgaactacaacctgatcatcatggacgaggcccacttcaccgaccccgccagcatcgcggcccgcggctacatctccacgcgggtggagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagacggtctggttcgtgccgagcatcaaggccgggaacgacatcgccgcctgcctccggaagaacggcaagaaggtgatccagctgtcccgcaagaccttcgacttcgagtacatcaagacccggaccaacgactgggacttcgtcgtgacgaccgacatcagcgagatgggcgcgaacttcaaggccgagcgcgtgatcgacccccggcgctgcatgaagcccgtcatcctgaccgacggggaggagcgggtgatcctcgccggccccatgccggtgacccactccagcgccgcccagcgccgggggcgcgtcggccgcaaccccaagaacgagaacgaccagtacatctacatgggggagcccctggagaacgacgaggactgcgcgcactggaaggaggccaagatgctgctcgacaacatcaacacgcccgagggcatcatcccgtccatgttcgagcccgagcgggagaaggtggacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggccctcaaggagttcaaggagttcgcggccggccggaagtccctgaccctgaacctcatcacggagatgggccgcctgcccaccttcatgacccagaaggcccggaacgccctggacaacctcgcggtcctgcacaccgccgaggccgggggccgcgcctacaaccacgccctgagcgagctccccgagacgctggagaccctgctcctgctgaccctcctggcgaccgtgaccgggggcatcttcctgttcctcatgtccggcaaggggatcggcaagatgacgctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcacggtggtcgccgccaccatggccaacgagatgggcttcctggagaagaccaagaaggacttcgggctgggcagcatcaccacgcagcagccggagagcaacatcctcgacatcgacctgcgccccgcctccgcgtggaccctgtacgccgtggccaccaccttcatcacgcccatgctccggcacagcatcgagaactccagcgtgaacgtctccctgaccgccatcgccaaccaggcgaccgtgctgatgggcctcgggaagggctggcccctgagcaagatggacatcggggtgccgctgctcgccatcggctgctactcccaggtcaaccccatcaccctgacggccgccctgctcctgctggtggcgcactacgccatcatcgggcccggcctccaggccaaggccacccgcgaggcccagaagcgggcggccgccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcgcaccacctgggccctgtgcgaggccctgaccctcgcgacggggcccatcagcaccctgtgggagggcaacccggggcgcttctggaacaccaccatcgccgtgtccatggccaacatcttccggggcagctacctggccggcgccgggctcctgttctccatcatgaagaacacggcgaacacccgccggggcaccgggaacaccggcgagacgctgggcgagaagtggaagaaccgcctcaacgccctgggcaagagcgagttccagatctacaagaagtccggcatccaggaggtcgaccggaccctggccaaggaggggatcaagcgcggcgagaccgaccaccacgccgtgagccgggggtccgcgaagctccgctggttcgtggagcggaacctggtcacccccgagggcaaggtggtggacctgggctgcgggcgcggcgggtggagctactactgcggcgggctcaagaacgtcaaggaggtgaagggcctgacgaagggcgggcccggccacgaggagcccatcccgatgtccacctacgggtggaacctggtgcggctccagagcggcgtcgacgtgttcttcacgccgcccgagaagtgcgacaccctgctgtgcgacatcggggagtccagccccaacccgaccgtggaggccggccgcacgctccgggtcctgaacctggtggagaactggctcaacaacaacacccagttctgcatcaaggtgctgaacccctacatgcccagcgtcatcgagaagatggaggccctgcagcgcaagtacggcggggccctggtgcggaacccgctctcccgcaacagcacccacgagatgtactgggtgtccaacgccagcggcaacatcgtctccagcgtgaacatgatctcccggatgctgatcaaccgcttcaccatgcggcacaagaaggcgacgtacgagcccgacgtggacctggggagcggcacccgcaacatcgggatcgagtccgagacccccaacctcgacatcatcggcaagcgcatcgagaagatcaagcgggagcacgagaccagctggcactacgaccaggaccacccctacaagacgtgggcctaccacggctcctacgagaccaagcagaccgggagcgcctccagcatggtcaacggcgtggtgcgcctgctgaccaagccgtgggacgtcatccccatggtgacgcagatggccatgaccgacaccacccccttcgggcagcagcgggtgttcaaggagaaggtcgacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgctccaacgcggccctcggggccatcttcaccgacgagaacaagtggaagtccgcccgggaggccgtcgaggactccggcttctgggagctggtggacaaggagcgcaacctgcacctcgaggggaagtgcgagacgtgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtcgagggcgaggggctgcacaagctgggctacatcctccgggacgtgtccaagaaggagggcggggcgatgtacgccgacgacaccgccggctgggacacccgcatcaccctggaggacctgaagaacgaggagatggtgacgaaccacatggagggggagcacaagaagctcgccgaggccatcttcaagctgacctaccagaacaaggtcgtgcgggtgcagcgccccacgccccggggcaccgtcatggacatcatcagccgccgggaccagcgcgggtccggccaggtggtgacgtacggcctgaacaccttcaccaacatggaggcgcagctcatccgccagatggagggggagggcgtcttcaagagcatccagcacctgaccgtgacggaggagatcgccgtgaagaactggctggtccgggtggggcgcgagcggctctcccgcatggccatcagcggcgacgactgcgtggtcaagcccctggacgaccggttcgcctccgccctgaccgcgctcaacgacatgggcaaggtgcgcaaggacatccagcagtgggagccgagccgggggtggaacgactggacccaggtgcccttctgctcccaccacttccacgagctgatcatgaaggacggccgcgtcctggtggtgccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtcccctcccactgggtgccgaccagccgcacgacctggtccatccacgccacccacgagtggatgaccacggaggacatgctcaccgtgtggaaccgggtctggatccaggagaacccctggatggaggacaagacccccgtggagagctgggaggagatcccctacctgggcaagcgcgaggaccagtggtgcgggagcctgatcggcctcacctcccgggcgacgtgggccaagaacatccagaccgccatcaaccaggtgcgcagcctgatcgggaacgaggagtacaccgactacatgccgtccatgaagcgcttccggcgcgaggaggaggaggccggcgtcctgtggtga

SEQ ID NO: 9687 - RNA, 9876 nt, synthetic construct
  misc_feature 1..9876: note = derived and/or modified CDS sequence (opt1) from DENV-2__KC762659__SS-prME
  source 1..9876: mol_type = other RNA
accgcgggcatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccacccggggttcacgatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaaggtggtccagcccgagaacctcgagtacaccatcgtgatcacgccccactccggcgaggagaacgccgtggggaacgacaccggcaagcacgggaaggagatcaaggtcaccccgcagagctccatcaccgaggccgagctgaccggctacgggacggtgaccatggagtgcagcccccgcaccggcctggacttcaacgagatggtgctcctgcagatggagaacaaggcctggctggtccaccggcagtggttcctcgacctgcccctgccctggctcccgggcgccgacacccaggggtccaactggatccagaaggagacgctggtgaccttcaagaacccccacgcgaagaagcaggacgtcgtggtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtcgtgaaggagatcgccgagacccagcacggcacgatcgtgatccgcgtccagtacgagggggacggcagcccctgcaagatccccttcgagatcatggacctggagaagcggcacgtgctgggccgcctcatcaccgtgaacccgatcgtcaccgagaaggactcccccgtgaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtcttcacctccatcggcaaggccctgcaccaggtgttcggggcgatctacggcgccgccttcagcggcgtgtcctggaccatgaagatcctcatcggggtcgtgatcacgtggatcggcatgaacagccgctccaccagcctgtccgtgagcctggtcctggtgggggtggtcaccctctacctgggcgtgatggtgcaggccgactccgggtgcgtcgtgagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtcacccgcctggagaacctgatgtggaagcagatcacccccgagctcaaccacatcctgtccgagaacgaggtgaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacaccaaccgggcctggaactccctggaggtggaggactacgggttcggcgtcttcacgaccaacatctggctcaagctgaaggagcgccaggacgtgttctgcgacagcaagctgatgtccgccgccatcaaggacaaccgggccgtgcacgcggacatggggtactggatggagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagacggccggcccctggcacctcgggcggctggagatggacttcgacttctgcgagggcaccaccgtcgtggtgaccgaggactgcgggaaccgcggccccagcctgcggacgaccaccgcgtccggcaagctcatcaccgagtggtgctgccgcagctgcacgctgcccccgctgcggtaccgcggggaggacggctgctggtacgggatggagatccggcccctcaaggagaaggaggagaacctggtcaactccctggtgaccgccggccacgggcagatcgacaacttcagcctcggcgtgctgggcatggccctgttcctcgaggagatgctgcgcacccgggtcgggaccaagcacgccatcctgctcgtggcggtgtccttcgtcacgctgatcaccggcaacatgagcttccgcgacctggggcgcgtgatggtgatggtcggcgccaccatgaccgacgacatcgggatgggcgtgacgtacctcgccctgctggccgccttcaaggtgcggcccaccttcgcggccggcctcctgctgcgccggctcacctccaaggagctgatgatgaccacgatcgggatcgtcctgctcagccagtccaccatccccgagaccatcctggagctgaccgacgccctcgccctgggcatgatggtgctgaagatcgtccgcaagatggagaagtaccagctcgccgtgacgatcatggcgatcctgtgcgtgccgaacgccgtcatcctgcagaacgcctggaaggtgagctgcaccaccctcgccgtggtctccgtgagccccctgctgctcacctccagccagcagaaggccgactggatccccctggcgctgacgatcaaggggctcaaccccaccgccatcttcctgaccaccctgtcccggacgagcaagaagcgctcctggccgctcaacgaggccatcatggccgtgggcatggtcagcatcctggcgtccagcctgctcaagaacgacatccccatgaccggccccctggtggccgggggcctgctcaccgtgtgctacgtcctgaccgggcggagcgccgacctggagctcgagcgcgccgccgacgtgcggtgggaggagcaggcggagatctccggcagctcccccatcctgagcatcacgatctccgaggacgggagcatgtccatcaagaacgaggaggaggagcagaccctgaccatcctcatccgcaccggcctgctggtgatcagcggcctcttcccggtctccatccccatcaccgccgccgcctggtacctgtgggaggtgaagaagcagcgggccggggtgctgtgggacgtccccagcccgccgcccgtgggcaaggcggagctcgaggacggggcctaccgcatcaagcagaagggcatcctggggtactcccagatcggcgccggcgtgtacaaggaggggacgttccacaccatgtggcacgtcacccggggcgccgtgctgatgcacaaggggaagcgcatcgagcccagctgggccgacgtgaagaaggacctcatctcctacggcgggggctggaagctggagggcgagtggaaggagggggaggaggtccaggtgctggcgctcgagcccggcaagaacccccgggccgtgcagaccaagcccgggctgttcaagacgaacaccggcaccatcggggccgtcagcctggacttctcccccggcaccagcggctcccccatcgtggacaagaaggggaaggtggtcggcctctacgggaacggcgtggtgacgcgcagcggcacctacgtctccgccatcgcccagaccgagaagtccatcgaggacaaccccgagatcgaggacgacatcttccggaagaagcgcctgaccatcatggacctgcaccccggggcgggcaagacgaagcggtacctgcccgccatcgtgcgcgaggccatcaagcgggggctccgcaccctgatcctggccccgacccgcgtggtcgcggccgagatggaggaggccctccggggcctgcccatccgctaccagacccccgccatccgggccgagcacacggggcgcgagatcgtggacctgatgtgccacgcgaccttcaccatgcggctcctgagccccatccgcgtgccgaactacaacctgatcatcatggacgaggcccacttcaccgaccccgcctccatcgccgcccggggctacatcagcacgcgcgtcgagatgggcgaggcggccgggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagacggtgtggttcgtcccgtccatcaaggccgggaacgacatcgcggcctgcctccgcaagaacggcaagaaggtgatccagctgagccggaagaccttcgacttcgagtacatcaagacccgcaccaacgactgggacttcgtggtcacgaccgacatctccgagatgggcgccaacttcaaggccgagcgggtgatcgacccccgccggtgcatgaagcccgtgatcctgaccgacggggaggagcgcgtcatcctcgcgggccccatgccggtgacccacagctccgccgcccagcggcgcgggcgcgtgggccggaaccccaagaacgagaacgaccagtacatctacatgggggagcccctggagaacgacgaggactgcgcccactggaaggaggccaagatgctgctcgacaacatcaacacgcccgagggcatcatcccgagcatgttcgagcccgagcgcgagaaggtcgacgcgatcgacggcgagtaccggctgcgcggggaggcccggaagaccttcgtggacctgatgcgccggggcgacctccccgtctggctggcctaccgcgtggccgccgaggggatcaactacgcggaccggcgctggtgcttcgacggcgtgaagaacaaccagatcctggaggagaacgtcgaggtggagatctggaccaaggagggggagcggaagaagctcaagccgcgctggctggacgcccggatctactccgaccccctggccctcaaggagttcaaggagttcgccgccggccgcaagagcctgaccctgaacctcatcacggagatgggccggctgcccaccttcatgacccagaaggcgcgcaacgccctggacaacctcgccgtgctgcacaccgccgaggccggcgggcgggcctacaaccacgccctgtccgagctccccgagacgctggagaccctgctcctgctgaccctcctggccaccgtcaccggcgggatcttcctgttcctcatgagcgggaaggggatcggcaagatgacgctggggatgtgctgcatcatcaccgcctccatcctgctctggtacgcgcagatccagccgcactggatcgccgccagcatcatcctggagttcttcctgatcgtgctcctgatccccgagcccgagaagcagcgcacgccccaggacaaccagctgacctacgtggtcatcgccatcctcacggtggtggccgcgaccatggccaacgagatgggcttcctggagaagaccaagaaggacttcgggctgggctccatcaccacgcagcagagcgagagcaacatcctcgacatcgacctgcggccggcctccgcctggaccctgtacgccgtcgcgaccaccttcatcacgcccatgctccgccacagcatcgagaactccagcgtgaacgtgtccctgaccgccatcgccaaccaggccaccgtcctgatgggcctcgggaagggctggcccctgagcaagatggacatcggggtgcccctgctcgccatcggctgctactcccaggtgaacccgatcaccctgacggcggccctgctcctgctggtcgcccactacgccatcatcgggcccggcctccaggcgaaggccacccgggaggcccagaagcgcgccgccgcgggcatcatgaagaaccccaccgtggacgggatcaccgtgatcgacctggaccccatcccgtacgaccccaagttcgagaagcagctgggccaggtcatgctcctggtgctgtgcgtgacgcaggtcctcatgatgcgcaccacctgggccctgtgcgaggccctgaccctcgccacggggcccatcagcaccctgtgggagggcaaccccgggcggttctggaacaccaccatcgccgtgtccatggcgaacatcttccgcggcagctacctggccggcgccgggctcctgttctccatcatgaagaacacggccaacacccggcgcggcaccgggaacaccggcgagacgctgggcgagaagtggaagaaccggctcaacgccctgggcaagagcgagttccagatctacaagaagtccggcatccaggaggtggaccgcaccctggcgaaggaggggatcaagcggggcgagaccgaccaccacgccgtcagccgcgggtccgccaagctccggtggttcgtggagcgcaacctggtgaccccggagggcaaggtcgtggacctgggctgcgggcggggcgggtggagctactactgcggcgggctcaagaacgtgaaggaggtcaagggcctgacgaagggcgggcccggccacgaggagcccatccccatgtccacctacgggtggaacctggtgcgcctccagagcggcgtggacgtcttcttcaccccgcccgagaagtgcgacaccctgctgtgcgacatcggggagtccagccccaaccccaccgtggaggccggccggacgctccgcgtgctgaacctggtcgagaactggctcaacaacaacacccagttctgcatcaaggtgctgaacccgtacatgcccagcgtgatcgagaagatggaggcgctgcagcggaagtacggcggggccctggtccgcaaccccctctcccggaacagcacccacgagatgtactgggtgtccaacgccagcggcaacatcgtgtccagcgtcaacatgatctcccgcatgctgatcaaccggttcaccatgcgccacaagaaggccacgtacgagccggacgtggacctggggagcggcacccgcaacatcgggatcgagtccgagacccccaacctcgacatcatcggcaagcggatcgagaagatcaagcaggagcacgagaccagctggcactacgaccaggaccacccctacaagacgtgggcctaccacggctcctacgagaccaagcagaccgggagcgcgtccagcatggtgaacggcgtcgtgcgcctgctgaccaagccctgggacgtgatcccgatggtcacgcagatggccatgaccgacaccacccccttcgggcagcagcgggtgttcaaggagaaggtcgacacgcgcacccaggagcccaaggagggcaccaagaagctcatgaagatcaccgccgagtggctgtggaaggagctgggcaagaagaagacgccccggatgtgcacccgcgaggagttcacccggaaggtgcgctccaacgccgccctcggggcgatcttcaccgacgagaacaagtggaagtccgcccgggaggccgtggaggactccggcttctgggagctggtcgacaaggagcgcaacctgcacctcgaggggaagtgcgagacgtgcgtgtacaacatgatgggcaagcgggagaagaagctgggggagttcggcaaggccaagggcagccgcgccatctggtacatgtggctgggggcgcggttcctcgagttcgaggccctgggcttcctgaacgaggaccactggttctcccgcgagaacagcctcagcggggtggagggcgaggggctgcacaagctgggctacatcctccgggacgtctccaagaaggagggcggggccatgtacgccgacgacaccgcgggctgggacacccgcatcaccctggaggacctgaagaacgaggagatggtgacgaaccacatggagggggagcacaagaagctcgccgaggccatcttcaagctgacctaccagaacaaggtggtccgggtgcagcgcccgacgccccggggcaccgtgatggacatcatcagccgccgggaccagcgcgggtccggccaggtcgtgacgtacggcctgaacaccttcaccaacatggaggcccagctcatccgccagatggagggggagggcgtgttcaagagcatccagcagctgaccgccacggaggagatcgcggtcaagaactggctggtgcgggtggggcgcgagcggctctcccgcatggccatcagcggcgacgactgcgtcgtgaagcccctggacgaccggttcgcctccgccctgaccgccctcaacgacatgggcaaggtgcgcaaggacatccagcagtgggagcccagccgggggtggaacgactggacccaggtcccgttctgctcccaccacttccacgagctgatcatgaaggacggccgcgtgctggtggtcccctgccggaaccaggacgagctcatcgggcgcgcgcggatcagccagggcgccgggtggtccctgcgcgagaccgcctgcctgggcaagagctacgcccagatgtggtccctcatgtacttccaccggcgcgacctgcggctggccgcgaacgccatctgcagcgccgtgccctcccactgggtgcccaccagccgcacgacctggtccatccacgccacccacgagtggatgaccacggaggacatgctcaccgtctggaaccgggtgtggatccaggagaacccgtggatcgaggacaagacccccgtggagagctgggaggagatcccctacctgggcaagcgcgaggaccagtggtgcgggagcctgatcggcctcacctcccgggccacgtgggcgaagaacatccagaccgccatcaaccaggtccgcagcctgatcgggaacgaggagtacaccgactacatgccctccatgaagcgcttccggcgcgaggaggaggaggccggcgtgctgtggtga

SEQ ID NO: 9688 - RNA, 9876 nt, synthetic construct
  misc_feature 1..9876: note = derived and/or modified CDS sequence (opt1) from DENV-2__KC762657__SS-prME
  source 1..9876: mol_type = other RNA
accgcgggcatcatcatcatgatgatccccaccgtgatggtgttccacctgaccacccgcaacggggagccccacatgatcgtgagccggcaggagaagggcaagagcctcctgttcaagaccgagaacggggtgaacatgtgcaccctgatggccatggacctcggcgagctgtgcgaggacaccatcacctacaactgccccctgctccgccagaacgagcccgaggacatcgactgctggtgcaacagcaccagcacctgggtcacctacgggacctgcaccgcgaccggcgagcaccggcgcgagaagcggagcgtggccctggtgccccacgtcggcatggggctggagacgcgcaccgagacctggatgtccagcgagggcgcctggaagcacgcccagcggatcgagacctgggtgctccgccacccggggttcacgatcatggccgcgatcctggcctacaccatcggcaccacctacttccagcgggtgctgatcttcatcctcctgacggccgtcaccccctccatgaccatgcgctgcatcgggatcagcaaccgggacttcgtggagggcgtgtccggcgggagctgggtcgacatcgtgctggagcacggctcctgcgtgaccacgatggccaagaacaagcccaccctcgacttcgagctgatcaagaccgaggcgaagcaccccgccaccctgcgcaagtactgcatcgaggccaagctcacgaacaccaccaccgccagccggtgcccgacgcagggggagccctccctgaacgaggagcaggacaagcgcttcgtctgcaagcacagcatggtggaccggggctggggcaacgggtgcggcctgttcgggaagggcgggatcgtgacctgcgccatgttcacgtgcaagaagaacatggagggcaaggtcgtgcagcccgagaacctcgagtacaccatcgtgatcacgccccactccggcgaggagaacgcggtcgggaacgacaccggcaagcacgggaaggagatcaaggtgaccccgcagagctccatcaccgaggccgagctgaccggctacgggacggtgaccatggagtgcagcccccgcaccggcctggacttcaacgagatggtcctcctgcagatggagaacaaggcctggctggtgcaccggcagtggttcctcgacctgcccctgccctggctcccgggcgccgacacccaggggtccaactggatccagaaggagacgctggtcaccttcaagaacccccacgccaagaagcaggacgtggtggtcctgggcagccaggagggggcgatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtgaaggagatcgccgagacccagcacggcacgatcgtcatccgcgtgcagtacgagggggacggcagcccctgcaagatccccttcgagatcatggacctggagaagcggcacgtgctgggccgcctcatcaccgtcaacccgatcgtgaccgagaaggactcccccgtgaacatcgaggccgagccgcccttcggggacagctacatcatcatcggcgtcgagccggggcagctgaagctgtcctggttcaagaagggcagctccatcgggcagatgttcgagaccacgatgcgcggcgcgaagcggatggccatcctcggcgacaccgcctgggacttcgggagcctgggcggggtgttcacctccatcggcaaggccctgcaccaggtgttcggggccatctacggcgcggccttcagcggcgtctcctggaccatgaagatcctcatcggggtggtgatcacgtggatcggcatgaacagccgctccaccagcctgtccgtcagcctggtgctggtgggggtcgtgaccctctacctgggcgtgatggtccaggccgactccgggtgcgtggtgagctggaagaacaaggagctgaagtgcggcagcggcatcttcatcaccgacaacgtccacacgtggaccgagcagtacaagttccagcccgagtcccccagcaagctcgcctccgcgatccagaaggcccacgaggaggggatctgcggcatccggagcgtgacccgcctggagaacctgatgtggaagcagatcacccccgagctcaaccacatcctgtccgagaacgaggtgaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgccgagtgcccgaacaccaaccgggcgtggaactccctggaggtcgaggactacgggttcggcgtgttcacgaccaacatctggctcaagctgaaggagcgccaggacgtgttctgcgacagcaagctgatgtccgccgccatcaaggacaaccgggccgtccacgccgacatggggtactggatggagagcgcgctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagacggccggcccctggcacctcgggcggctggagatggacttcgacttctgcgagggcaccaccgtggtggtcaccgaggactgcgggaaccgcggccccagcctgcggacgaccaccgcctccggcaagctcatcaccgagtggtgctgccgcagctgcacgctgcccccgctgcggtaccgcggggaggacggctgctggtacgggatggagatccggcccctcaaggagaaggaggagaacctggtgaactccctggtgaccgcgggccacgggcagatcgacaacttcagcctcggcgtcctgggcatggccctgttcctcgaggagatgctgcgcacccgggtggggaccaagcacgccatcctgctcgtggccgtctccttcgtgacgctgatcaccggcaacatgagcttccgcgacctggggcgcgtgatggtcatggtgggcgcgaccatgaccgacgacatcgggatgggcgtgacgtacctcgccctgctggccgccttcaaggtccggcccaccttcgccgcgggcctcctgctgcgccggctcacctccaaggagctgatgatgaccacgatcgggatcgtgctgctcagccagtccaccatccccgagaccatcctggagctgaccgacgccctcgccctgggcatgatggtcctgaagatcgtgcgcaagatggagaagtaccagctcgccgtgacgatcatggccatcctgtgcgtcccgaacgcggtgatcctgcagaacgcctggaaggtgagctgcaccaccctcgccgtcgtgtccgtgagccccctgctgctcacctccagccagcagaaggccgactggatccccctggccctgacgatcaaggggctcaaccccaccgcgatcttcctgaccaccctgtcccggacgagcaagaagcgctcctggccgctcaacgaggccatcatggccgtcggcatggtgagcatcctggcctccagcctgctcaagaacgacatccccatgaccggccccctggtggccggcgggctgctcaccgtctgctacgtgctgaccgggcggagcgccgacctggagctcgagcgcgccgccgacgtgcggtgggaggagcaggccgagatctccgggagctcccccatcctgagcatcacgatctccgaggacgggagcatgtccatcaagaacgaggaggaggagcagaccctgaccatcctcatccgcaccggcctgctggtcatcagcggcctcttcccggtgtccatccccatcaccgcggccgcctggtacctgtgggaggtgaagaagcagcgggccggggtcctgtgggacgtgcccagcccgccgcccgtgggcaaggccgagctcgaggacggggcgtaccgcatcaagcagaagggcatcctggggtactcccagatcggcgccggcgtctacaaggaggggacgttccacaccatgtggcacgtgacccggggcgccgtgctgatgcacaaggggaagcgcatcgagcccagctgggccgacgtcaagaaggacctcatctcctacggcgggggctggaagctggagggcgagtggaaggagggggaggaggtccaggtgctggccctcgagcccggcaagaacccccgggcggtccagaccaagcccgggctgttcaagacgaacaccggcaccatcggggccgtgagcctggacttctcccccggcaccagcggctcccccatcgtggacaagaaggggaaggtcgtgggcctctacgggaacggcgtggtcacgcgcagcggcacctacgtgtccgccatcgcccagaccgagaagtccatcgaggacaaccccgagatcgaggacgacatcttccggaagaagcgcctgaccatcatggacctgcaccccggggccggcaagacgaagcggtacctgcccgcgatcgtgcgcgaggccatcaagcgggggctccgcaccctgatcctggccccgacccgcgtcgtggccgcggagatggaggaggccctccggggcctgcccatccgctaccagacccccgccatccgggccgagcacacggggcgcgagatcgtggacctgatgtgccacgccaccttcaccatgcggctcctgagccccatccgcgtcccgaactacaacctgatcatcatggacgaggcgcacttcaccgaccccgcctccatcgccgcccggggctacatcagcacgcgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagacggtctggttcgtgccgtccatcaaggccgggaacgacatcgccgcgtgcctccgcaagaacggcaagaaggtgatccagctgagccggaagaccttcgacttcgagtacatcaagacccgcaccaacgactgggacttcgtcgtgacgaccgacatctccgagatgggcgccaacttcaaggccgagcgggtgatcgacccccgccggtgcatgaagcccgtcatcctgaccgacggggaggagcgcgtgatcctcgccggccccatgccggtgacccacagctccgcggcccagcggcgcgggcgcgtcggccggaaccccaagaacgagaacgaccagtacatctacatgggggagcccctggagaacgacgaggactgcgcccactggaaggaggccaagatgctgctcgacaacatcaacacgcccgagggcatcatcccgagcatgttcgagcccgagcgcgagaaggtggacgccatcgacggcgagtaccggctgcgcggggaggcgcggaagaccttcgtcgacctgatgcgccggggcgacctccccgtgtggctggcctaccgcgtggccgccgaggggatcaactacgccgaccggcgctggtgcttcgacggcgtcaagaacaaccagatcctggaggagaacgtggaggtggagatctggaccaaggagggggagcggaagaagctcaagccgcgctggctggacgcgcggatctactccgaccccctggccctcaaggagttcaaggagttcgccgccggccgcaagagcctgaccctgaacctcatcacggagatgggccggctgcccaccttcatgacccagaaggcccgcaacgcgctggacaacctcgccgtcctgcacaccgccgaggccgggggccgggcgtacaaccacgccctgtccgagctccccgagacgctggagaccctgctcctgctgaccctcctggccaccgtgaccgggggcatcttcctgttcctcatgagcggcaaggggatcggcaagatgacgctggggatgtgctgcatcatcaccgcctccatcctgctctggtacgcccagatccagccgcactggatcgcggccagcatcatcctggagttcttcctgatcgtgctcctgatccccgagcccgagaagcagcgcacgccccaggacaaccagctgacctacgtcgtgatcgccatcctcacggtggtcgccgccaccatggcgaacgagatgggcttcctggagaagaccaagaaggacttcgggctgggctccatcaccacgcagcagagcgagagcaacatcctcgacatcgacctgcggccggcctccgcctggaccctgtacgccgtggccaccaccttcatcacgcccatgctccgccacagcatcgagaactccagcgtgaacgtctccctgaccgcgatcgccaaccaggccaccgtgctgatgggcctcgggaagggctggcccctgagcaagatggacatcggggtgcccctgctcgccatcggctgctactcccaggtcaacccgatcaccctgacggccgcgctgctcctgctggtggcccactacgccatcatcgggcccggcctccaggccaaggcgacccgggaggcccagaagcgcgccgccgccggcatcatgaagaaccccaccgtggacgggatcaccgtcatcgacctggaccccatcccgtacgaccccaagttcgagaagcagctgggccaggtgatgctcctggtgctgtgcgtcacccaggtgctcatgatgcgcaccacctgggcgctgtgcgaggccctgaccctcgccacggggcccatcagcaccctgtgggagggcaaccccgggcggttctggaacaccaccatcgccgtgtccatggccaacatcttccgcggcagctacctggcgggcgccgggctcctgttctccatcatgaagaacacggccaacacccggcgcggcaccgggaacaccggcgagacgctgggcgagaagtggaagaaccggctcaacgccctgggcaagagcgagttccagatctacaagaagtccggcatccaggaggtcgaccgcaccctggccaaggaggggatcaagcggggcgagaccgaccaccacgcggtgagccgcgggtccgccaagctccggtggttcgtggagcgcaacctggtcaccccggagggcaaggtggtggacctgggctgcgggcggggcgggtggagctactactgcggcgggctcaagaacgtcaaggaggtgaagggcctgacgaagggcgggcccggccacgaggagcccatccccatgtccacctacgggtggaacctggtgcgcctccagagcggcgtcgacgtgttcttcaccccgcccgagaagtgcgacaccctgctgtgcgacatcggggagtccagccccaaccccaccgtggaggccggccggacgctccgcgtcctgaacctggtggagaactggctcaacaacaacacccagttctgcatcaaggtgctgaacccgtacatgcccagcgtcatcgagaagatggaggccctgcagcggaagtacggcggggcgctggtgcgcaaccccctctcccggaacagcacccacgagatgtactgggtgtccaacgccagcggcaacatcgtctccagcgtgaacatgatctcccgcatgctgatcaaccggttcaccatgcgccacaagaaggccacgtacgagccggacgtggacctggggagcggcacccgcaacatcgggatcgagtccgagacccccaacctcgacatcatcggcaagcggatcgagaagatcaagcaggagcacgagaccagctggcactacgaccaggaccacccctacaagacgtgggcctaccacggctcctacgagaccaagcagaccgggagcgcctccagcatggtcaacggcgtggtgcgcctgctgaccaagccctgggacgtcatcccgatggtgacgcagatggcgatgaccgacaccacccccttcgggcagcagcgggtcttcaaggagaaggtggacacgcgcacccaggagcccaaggagggcaccaagaagctcatgaagatcaccgccgagtggctgtggaaggagctgggcaagaagaagacgccccggatgtgcacccgcgaggagttcacccggaaggtgcgctccaacgccgccctcggggccatcttcaccgacgagaacaagtggaagtccgcgcgggaggccgtcgaggactccggcttctgggagctggtggacaaggagcgcaacctgcacctcgaggggaagtgcgagacgtgcgtgtacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctcagcggggtcgagggcgaggggctgcacaagctgggctacatcctccgggacgtgtccaagaaggagggcggggccatgtacgccgacgacaccgccggctgggacacccgcatcaccctggaggacctgaagaacgaggagatggtgacgaaccacatggagggggagcacaagaagctcgcggaggccatcttcaagctgacctaccagaacaaggtcgtgcgggtgcagcgcccgacgccccggggcaccgtcatggacatcatcagccgccgggaccagcgcgggtccggccaggtggtgacgtacggcctgaacaccttcaccaacatggaggcccagctcatccgccagatggagggggagggcgtcttcaagagcatccagcacctgaccgccacggaggagatcgccgtgaagaactggctggtgcgggtcgggcgcgagcggctctcccgcatggcgatcagcggcgacgactgcgtggtgaagcccctggacgaccggttcgcctccgccctgaccgccctcaacgacatgggcaaggtccgcaaggacatccagcagtgggagcccagccgggggtggaacgactggacccaggtgccgttctgctcccaccacttccacgagctgatcatgaaggacggccgcgtgctggtcgtgccctgccggaaccaggacgagctcatcgggcgcgcccggatcagccagggcgcggggtggtccctgcgcgagaccgcctgcctgggcaagagctacgcccagatgtggtccctcatgtacttccaccggcgcgacctgcggctggccgccaacgcgatctgcagcgccgtgccctcccactgggtccccaccagccgcacgacctggtccatccacgccacccacgagtggatgaccacggaggacatgctcaccgtgtggaaccgggtgtggatccaggagaacccgtggatcgaggacaagacccccgtcgagagctgggaggagatcccctacctgggcaagcgcgaggaccagtggtgcgggagcctgatcggcctcacctcccgggccacgtgggccaagaacatccagaccgcgatcaaccaggtgcgcagcctgatcgggaacgaggagtacaccgactacatgccctccatgaagcgcttccggcgcgaggaggaggaggccggcgtgctgtggtga

SEQ ID NO: 9689 - RNA, 9876 nt, synthetic construct
  misc_feature 1..9876: note = derived and/or modified CDS sequence (opt1) from DENV-2__KC762666__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtgaccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtcgaccggggctggggcaacgggtgcggcctgttcgggaagggcgggatcgtgacctgcgcgatgttcacgtgcaagaagaacatggagggcaagatcgtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggagaacaaggcctggctggtgcaccggcagtggttcctcgacctgcccctgccctggctcccgggcgccgacacccaggggtccaactggatccagaaggagacgctggtcaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgccgagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggcggagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggccctgcaccaggtcttcggggcgatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggccgactccgggtgcgtggtcagctggaagaacaaggagctgaagtgcggcagcggcatcttcatcaccgacaacgtgcacacgtggaccgagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacgccaaccgggcctggaactccctggaggtggaggactacgggttcggcgtgttcaccacgaacatctggctcaagctgaaggagcgccaggacgccttctgcgacagcaagctgatgtccgccgcgatcaaggacaaccgggccgtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtggtggtcaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtgacggccggccacgggcagatcgacaacttcagcctcggcgtcctgggcatggcgctgttcctcgaggagatgctgcgcacccgggtggggaccaagcacgccatcctgctcgtggccgtctccttcgtgaccctgatcacgggcaacatgagcttccgcgacctggggcgcgtgatggtcatggtgggcgccaccatgaccgacgacatcgggatgggcgtgacctacctcgccctgctggcggccttcaaggtccggcccacgttcgccgccggcctcctgctgcgcaagctcacctccaaggagctgatgatgaccaccatcgggatcacgctgctcagccagtccaccatccccgagaccatcctggagctgaccgacgccctcgcgctgggcatgatggtgctgaagatcgtgcggaacatggagaagtaccagctcgccgtcacgatcatggccatcctgtgcgtgccgaacgccgtcatcctgcagaacgcctggaaggtgagctgcaccaccctcgcggtggtctccgtgagccccctgctgctcacctccagccagcagaaggccgactggatccccctggccctgacgatcaaggggctcaaccccaccgccatcttcctgaccaccctgtcccgcacgagcaagaagcggtcctggccgctcaacgaggcgatcatggccgtgggcatggtcagcatcctggcctccagcctgctcaagaacgacatccccatgaccggccccctggtggccgggggcctgctcaccgtgtgctacgtcctgaccgggcgcagcgccgacctggagctcgagcgggcggccgacgtgcgctgggaggagcaggccgagatctccggcagctcccccatcctgagcatcacgatctccgaggacgggagcatgtccatcaagaacgaggaggaggagcagaccctgaccatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggacgttccacaccatgtggcacgtcacccgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagacgagcaccggcaccatcggggccgtctccctggacttcagccccggcacctccggcagccccatcgtggacaagaaggggaaggtggtcggcctctacgggaacggcgtggtgacgcggtccggcacctacgtcagcgcgatcgcccagaccgagaagtccatcgaggacaaccccgagatcgaggacgacatcttccgcaagaagcggctgaccatcatggacctgcaccccggggccggcaagacgaagcgctacctgcccgccatcgtgcgggaggcgatcaagcgcgggctccggaccctgatcctggccccgacccgcgtggtcgccgccgagatggaggaggccctccgcggcctgcccatccggtaccagacccccgcgatccgcgccgagcacacggggcgggagatcgtggacctgatgtgccacgccaccttcaccatgcgcctcctgtcccccatccgggtgccgaactacaacctgatcatcatggacgaggcccacttcaccgaccccgccagcatcgcggcccgcggctacatctccacgcgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagacggtgtggttcgtcccgagcatcaaggccgggaacgacatcgccgcctgcctccggaagaacggcaagaaggtgatccagctgtcccgcaagaccttcgacttcgagtacatcaagacccggaccaacgactgggacttcgtggtcacgaccgacatcagcgagatgggcgcgaacttcaaggccgagcgcgtgatcgacccccggcgctgcatgaagcccgtgatcctgaccgacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacgcccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcctaccgggtcgcggccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgaccctgaacctcatcacggagatgggccgcctgcccaccttcatgacccagaaggcccggaacgccctggacaacctcgcggtgctgcacaccgccgaggccgggggccgcgcctacaaccacgccctgagcgagctccccgagacgctggagaccctgctcctgctgaccctcctggcgaccgtcaccgggggcatcttcctgttcctcatgtccggcaaggggatcggcaagatgacgctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcacggtggtggccgccaccatggccaacgagatgggcttcctggagaagaccaagaaggacttcgggctgggcagcatcaccacgcagcagccggagagcaacatcctcgacatcgacctgcgccccgcctccgcgtggaccctgtacgccgtcgccaccaccttcatcacgcccatgctccggcacagcatcgagaactccagcgtgaacgtgtccctgaccgccatcgccaaccaggcgaccgtcctgatgggcctcgggaagggctggcccctgagcaagatggacatcggggtgccgctgctcgccatcggctgctactcccaggtgaaccccatcaccctgacggccgccctgctcctgctggtcgcgcactacgccatcatcgggcccggcctccaggccaaggccacccgcgaggcccagaagcgggcggccgccggcatcatgaagaaccccaccgtggacgggatcaccgtgatcgacctggacccgatcccctacgaccccaagttcgagaagcagctgggccaggtcatgctcctggtgctgtgcgtgacgcaggtcctcatgatgcgcaccacctgggccctgtgcgaggccctgaccctcgcgacggggcccatcagcaccctgtgggagggcaacccggggcgcttctggaacaccaccatcgccgtgtccatggccaacatcttccggggcagctacctggccggcgccgggctcctgttctccatcatgaagaacacggcgaacacccgccggggcaccgggaacaccggcgagacgctgggcgagaagtggaagaaccgcctcaacgccctgggcaagagcgagttccagatctacaagaagtccggcatccaggaggtggaccggaccctggccaaggaggggatcaagcgcggcgagaccgaccaccacgccgtcagccgggggtccgcgaagctccgctggttcgtggagcggaacctggtgacccccgagggcaaggtcgtggacctgggctgcgggcgcggcgggtggagctactactgcggcgggctcaagaacgtgaaggaggtcaagggcctgacgaagggcgggcccggccacgaggagcccatcccgatgtccacctacgggtggaacctggtgcggctccagagcggcgtggacgtcttcttcacgccgcccgagaagtgcgacaccctgctgtgcgacatcggggagtccagccccaacccgaccgtggaggccggccgcacgctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctctcccgcaacagcacccacgagatgtactgggtgtccaacgccagcggcaacatcgtgtccagcgtcaacatgatctcccggatgctgatcaaccgcttcaccatgcggcacaagaaggcgacgtacgagcccgacgtggacctggggagcggcacccgcaacatcgggatcgagtccgagacccccaacctcgacatcatcggcaagcgcatcgagaagatcaagcgggagcacgagaccagctggcactacgaccaggaccacccctacaagacgtgggcctaccacggctcctacgagaccaagcagaccgggagcgcctccagcatggtgaacggcgtcgtgcgcctgctgaccaagccgtgggacgtgatccccatggtcacgcagatggccatgaccgacaccacccccttcgggcagcagcgggtgttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtccgctccaacgcggccctcggggccatcttcaccgacgagaacaagtggaagtccgcccgggaggccgtggaggactccggcttctgggagctggtcgacaaggagcgcaacctgcacctcgaggggaagtgcgagacgtgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacccgcatcaccctggaggacctgaagaacgaggagatggtgacgaaccacatggagggggagcacaagaagctcgccgaggccatcttcaagctgacctaccagaacaaggtggtccgggtgcagcgccccacgccccggggcaccgtgatggacatcatcagccgccgggaccagcgcgggtccggccaggtcgtgacgtacggcctgaacaccttcaccaacatggaggcgcagctcatccgccagatggagggggagggcgtgttcaagagcatccagcagctgaccgtcacggaggagatcgccgtgaagaactggctggtgcgggtcgggcgcgagcggctctcccgcatggccatcagcggcgacgactgcgtggtgaagcccctggacgaccggttcgcctccgccctgaccgcgctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtgccctcccactgggtcccgaccagccgcacgacctggtccatccacgccacccacgagtggatgaccacggaggacatgctcaccgtgtggaaccgggtgtggatccaggagaacccctggatggaggacaagacccccgtcgagagctgggaggagatcccctacctgggcaagcgcgaggaccagtggtgcgggagcctgatcggcctcacctcccgggcgacgtgggccaagaacatccagaccgccatcaaccaggtgcgcagcctgatcgggaacgaggagtacaccgactacatgccgtccatgaagcgcttccggcgcgaggaggaggaggccggcgtgctgtggtga

SEQ ID NO: 9690 - RNA, 9876 nt, synthetic construct
  misc_feature 1..9876: note = derived and/or modified CDS sequence (opt1) from DENV-2__KC762677__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacccacttccagcgggtgctgatcttcatcctcctgaccgccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtctactgcgacagcaagctgatgtccgccgccatcaaggacaaccgggcggtgcacgccgacatggggtactggatcgagagcgccctcaacgacacctggaagatcgagaaggcctccttcatcgaggtcaagagctgctactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccatgaaggagaaggaggagaacctcgtgaactccctggtcacggccggccacgggcagatcgacaacttcagcctgggcgtgctcggcatggccctgttcctggaggagatgctccgcacccgggtggggaccaagcacgcgatcctgctggtcgccgtgtccttcgtgaccctcatcacgggcaacatgagcttccgcgacctggggcgcgtcatggtgatggtgggcgccaccatgaccgacgacatcgggatgggcgtcacctacctggccctcctggccgcgttcaaggtgcggcccacgttcgccgccggcctgctcctgcgcaagctgacctccaaggagctcatgatgaccaccatcgggatcgtgctgctgagccagtccacgatccccgagaccatcctcgagctgaccgacgccctggccctcggcatgatggcgctgaagatcgtccggaacatggagaagtaccagctggccgtgaccatcatggccatcctctgcgtcccgaacgccgtgatcctgcagaacgcctggaaggtgagctgcacgaccctggcggtcgtgtccgtgagccccctcctgctgacctccagccagcagaaggccgactggatccccctcgccctgaccatcaaggggctgaaccccacggccatcttcctcaccaccctgtcccgcaccagcaagaagcggtcctggccgctgaacgaggcgatcatggccgtcggcatggtgagcatcctcgcctccagcctgctgaagaacgacatccccatgacgggccccctcgtggccgggggcctgctgaccgtctgctacgtgctcaccgggcgcagcgccgacctggagctggagcgggcggccgacgtgcgctgggaggagcaggccgagatctccggcagctcccccatcctcagcatcaccatctccgaggacgggagcatgtccatcaagaacgaggaggaggagcagacgctgaccatcctgatccggaccggcctcctggtcatcagcggcctgttcccggtgtccatccccatcaccgccgccgcgtggtacctctgggaggtgaagaagcagcgcgccggggtcctgtgggacgtgcccagcccgccgcccgtgggcaaggccgagctggaggacggggcctaccggatcaagcagaagggcatcctcgggtactcccagatcggcgccggcgtctacaaggaggggaccttccacacgatgtggcacgtgacccgcggcgcggtgctgatgcacaaggggaagcggatcgagcccagctgggccgacgtcaagaaggacctgatctcctacggcgggggctggaagctcgagggcgagtggaaggagggggaggaggtccaggtgctggccctggagcccggcaagaacccccgcgccgtccagaccaagcccggcctgttcaagaccaacacgggcaccatcggggccgtgagcctggacttctcccccggcaccagcggctcccccatcgtggacaagaaggggaaggtcgtgggcctgtacgggaacggcgtggtcacccggagcggcacgtacgtgtccgcgatcgcccagaccgagaagtccatcgaggacaaccccgagatcgaggacgacatcttccgcaagaagcggctcaccatcatggacctgcaccccggggccggcaagaccaagcgctacctgcccgccatcgtgcgggaggcgatcaagcgcgggctgcggacgctcatcctggccccgacccgcgtcgtggccgccgagatggaggaggccctgcgcggcctccccatccggtaccagacccccgcgatccgcgccgagcacaccgggcgggagatcgtggacctgatgtgccacgccacgttcaccatgcgcctgctcagccccatccgggtcccgaactacaacctgatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctgcggaagaacggcaagaaggtgatccagctcagccgcaagacgttcgacttcgagtacatcaagacccggaccaacgactgggacttcgtcgtgaccacggacatctccgagatgggcgcgaacttcaaggccgagcgcgtgatcgacccccggcgctgcatgaagcccgtcatcctgaccgacggggaggagcgggtgatcctggccggccccatgccggtgacccacagctccgccgcccagcgccgggggcgcgtcggccgcaaccccaagaacgagaacgaccagtacatctacatgggggagcccctcgagaacgacgaggactgcgcgcactggaaggaggccaagatgctgctggacaacatcaacacccccgagggcatcatcccgagcatgttcgagcccgagcgggagaaggtggacgccatcgacggcgagtaccgcctccgcggggaggcccgcaagacgttcgtggacctgatgcggcgcggcgacctgcccgtctggctcgcctaccgggtggcggccgaggggatcaactacgccgaccgccggtggtgcttcgacggcgtcaagaacaaccagatcctggaggagaacgtggaggtggagatctggaccaaggagggggagcgcaagaagctgaagccgcggtggctcgacgcccgcatctactccgaccccctggccctgaaggagttcaaggagttcgcggccggccgcaagagcctcaccctgaacctgatcaccgagatgggccgcctccccacgttcatgacccagaaggcccggaacgccctggacaacctggcggtcctccacaccgccgaggccgggggccgcgcctacaaccacgccctgtccgagctgcccgagaccctcgagacgctgctgctcctgaccctgctcgcgaccgtgaccgggggcatcttcctgttcctgatgagcggcaaggggatcggcaagatgaccctcgggatgtgctgcatcatcacggcctccatcctgctgtggtacgcccagatccagccgcactggatcgccgccagcatcatcctcgagttcttcctgatcgtgctgctcatccccgagcccgagaagcagcggacgccccaggacaaccagctgacctacgtcgtgatcgcgatcctgaccgtggtcgccgccacgatggccaacgagatgggcttcctcgagaagaccaagaaggacttcgggctgggctccatcaccacccagcagccggagagcaacatcctggacatcgacctccgccccgccagcgcgtggacgctgtacgccgtggccaccaccttcatcacccccatgctgcggcactccatcgagaacagctccgtgaacgtcagcctcacggccatcgccaaccaggcgaccgtgctgatgggcctggggaagggctggcccctctccaagatggacatcggggtgccgctgctggccatcggctgctacagccaggtcaaccccatcaccctcaccgccgccctgctgctcctggtggcgcactacgccatcatcgggcccggcctgcaggccaaggccacgcgcgaggcccagaagcgggcggccgccggcatcatgaagaaccccaccgtggacgggatcaccgtcatcgacctcgacccgatcccctacgaccccaagttcgagaagcagctgggccaggtgatgctgctcgtgctgtgcgtcacccaggtgctgatgatgcgcacgacctgggccctctgcgaggccctgaccctggcgaccgggcccatctccacgctctgggagggcaacccggggcgcttctggaacaccaccatcgccgtgagcatggccaacatcttccggggctcctacctggccggcgccgggctcctcttcagcatcatgaagaacaccgcgaacacgcgccggggcaccgggaacaccggcgagaccctgggcgagaagtggaagaaccgcctgaacgccctcgggaagtccgagttccagatctacaagaagtccggcatccaggaggtcgaccggacgctggccaaggaggggatcaagcgcggcgagaccgaccaccacgccgtgtcccgggggagcgcgaagctgcgctggttcgtggagcggaacctcgtcacccccgagggcaaggtggtggacctgggctgcgggcgcggcgggtggtcctactactgcggcgggctgaagaacgtcaaggaggtgaagggcctcaccaagggcgggcccggccacgaggagcccatcccgatgagcacgtacgggtggaacctggtgcggctgcagtccggcgtcgacgtgttcttcacgccgcccgagaagtgcgacaccctcctgtgcgacatcggggagagctcccccaacccgaccgtggaggccggccgcaccctgcgggtcctcaacctggtggagaactggctgaacaacaacacgcagttctgcatcaaggtgctcaacccctacatgcccagcgtcatcgagaagatggaggccctgcagcgcaagtacggcggggccctggtgcggaacccgctgagccgcaactccacccacgagatgtactgggtgagcaacgcctccggcaacatcgtcagctccgtgaacatgatcagccggatgctcatcaaccgcttcaccatgcggcacaagaaggcgacctacgagcccgacgtggacctggggtccggcacgcgcaacatcgggatcgagagcgagatccccaacctggacatcatcggcaagcgcatcgagaagatcaagcaggagcacgagacctcctggcactacgaccaggaccacccctaccggacctgggcctaccacggcagctacgagaacaagcagaccgggtccgccagctccatggtcaacggcgtggtgcgcctcctgacgaagccgtgggacgtcatccccatggtgacccagatggccatgaccgacaccacgcccttcgggcagcagcgggtgttcaaggagaaggtcgacacccgcacccaggagcccaaggagggcaccaagaagctgatgaagatcacggccgagtggctctggaaggagctgggcaagaagaagaccccgcggatgtgcacccgcaaggagttcacccggaaggtgcgcagcaacgcggccctgggggccatcttcacggacgagaacaagtggaagtccgcccgggaggccgtcgaggacagcggcttctgggagctcgtggacaaggagcgcaacctgcacctggaggggaagtgcgagacctgcgtgtacaacatgatgggcaagcgggagaagaagctcggggagttcggcaaggcgaagggctcccgcgccatctggtacatgtggctgggggcccggttcctggagttcgaggccctcggcttcctgaacgaggaccactggttcagccgcgagaactccctgagcggggtcgagggcgaggggctccacaagctgggctacatcctgcgggacgtgagcaagaaggagggcggggcgatgtacgccgacgacaccgccggctgggacacccgcatcacgctcgaggacctgaagaacgaggagatggtgaccaaccacatggagggggagcacaagaagctggccgaggccatcttcaagctcacctaccagaacaaggtcgtgcgggtgcagcgccccacgccccggggcacggtcatggacatcatctcccgccgggaccagcgcgggagcggccaggtggtgacctacggcctgaacaccttcaccaacatggaggcgcagctgatccgccagatggagggggagggcgtcttcaagtccatccagcagctcacggtgaccgaggagatcgccgtgaagaactggctggtccgggtggggcgcgagcggctgagccgcatggccatctccggcgacgactgcgtggtcaagcccctcgacgaccggttcgccagcgccctgaccgcgctgaacgacatgggcaaggtgcgcaaggacatccagcagtgggagccgtcccgggggtggaacgactggacccaggtgcccttctgcagccaccacttccacgagctcatcatgaaggacggccgcgtcctggtggtgccctgccggaaccaggacgagctgatcgggcgcgcccggatctcccagggcgccgggtggagcctccgcgagacggcctgcctgggcaagtcctacgcccagatgtggagcctgatgtacttccaccggcgcgacctccggctggcggccaacgccatctgctccgccgtccccagccactgggtgccgacctcccgcaccacctggagcatccacgccacccacgagtggatgacgaccgaggacatgctgaccgtgtggaaccgggtctggatccaggagaacccctggatggaggacaagacccccgtggagtcctgggaggagatcccctacctcggcaagcgcgaggaccagtggtgcgggagcctgatcggcctgacgagccgggcgacctgggccaagaacatccagaccgccatcaaccaggtgcgctccctcatcgggaacgaggagtacaccgactacatgccgagcatgaagcgcttccggcgcgaggaggaggaggccggcgtcctgtggtga

SEQ ID NO: 9691 - RNA, 9876 nt, synthetic construct
  misc_feature 1..9876: note = derived and/or modified CDS sequence (opt1) from DENV-2__KC762668__SS-prME
  source 1..9876: mol_type = other RNA
accgccggcatcatcatcatggtgatccccaccgtcatggccttccacctgaccacccgcaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtcacctacgggacctgcaccgccaccggcgagcaccggcgcgagaagcggagcgtggccctggtgccccacgtcggcatggggctggagacccgcaccgagacctggatgtccagcgagggcgcctggaagcacgcccagcggatcgagacctgggtgctccgccacccggggttcaccatcatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaagatcgtccagcccgagaacctcgagtacaccatcgtgatcacgccccactccggcgaggagaacgccgtggggaacgacacgggcaagcacgggaaggagatcaagatcaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcaccacggtggtcgtgaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcaccgccggccacgggcagatcgacaacttcagcctcggcgtgctgggcatggcgctgttcctcgaggagatgctgcgcacgcgggtggggaccaagcacgccatcctgctcgtcgccgtgtccttcgtgaccctgatcaccggcaacatgagcttccgcgacctggggcgcgtcatggtgatggtgggcgccacgatgaccgacgacatcgggatgggcgtcacctacctcgccctgctggcggccttcaaggtgcggcccaccttcgccgccggcctcctgctgcgcaagctcacgtccaaggagctgatgatgaccaccatcgggatcgtgctgctcagccagtccaccatccccgagacgatcctggagctgaccgacgccctcgcgctgggcatgatggtcctgaagatcgtgcggaacatggagaagtaccagctcgccgtcaccatcatggccatcctgtgcgtgccgaacgccgtgatcctgcagaacgcctggaaggtcagctgcaccacgctcgcggtggtgtccgtcagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtgagcatcctggcctccagcctgctcaagaacgacatccccatgaccggccccctggtcgccgggggcctgctcacggtgtgctacgtgctgaccgggcgcagcgccgacctggagctcgagcgggcggccgacgtccgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtgtccatccccatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgccggcgtgtacaaggaggggaccttccacaccatgtggcacgtgacgcgcggcgcggtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggctgttcaagaccaacaccggcatcatcggggccgtgagcctggacttctcccccggcacgagcggctcccccatcgtcgacaagaaggggaaggtggtgggcctctacgggaacggcgtcgtgacccggagcggcacctacgtgtccgcgatcgcccagaccgagaagtccatcgaggacaaccccgagatcgaggacgacatcttccgcaagaagcggctgacgatcatggacctgcaccccggggccggcaagaccaagcgctacctgcccgccatcgtccgggaggcgatcaagcgcgggctccggaccctgatcctggccccgacccgcgtggtggccgccgagatggaggaggccctccgcggcctgcccatccggtaccagacgcccgcgatccgcgccgagcacaccgggcgggagatcgtcgacctgatgtgccacgccaccttcaccatgcgcctcctgagccccatccgggtgccgaactacaacctgatcatcatggacgaggcccacttcacggaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtcacggacttcaagggcaagaccgtgtggttcgtgccgtccatcaaggccgggaacgacatcgccgcctgcctccggaagaacggcaagaaggtcatccagctgagccgcaagaccttcgacttcgagtacatcaagacccggacgaacgactgggacttcgtggtgaccaccgacatctccgagatgggcgcgaacttcaaggccgagcgcgtcatcgacccccggcgctgcatgaagcccgtgatcctgaccgacggggaggagcgggtgatcctcgccggccccatgccggtcacgcacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcctaccgggtcgcggccgaggggatcaactacgccgaccgccggtggtgcttcgacggcgtgaagaacaaccagatcctggaggagaacgtggaggtcgagatctggaccaaggagggggagcgcaagaagctcaagccgcggtggctggacgcccgcatctactccgaccccctggccctcaaggagttcaaggagttcgcggccggccgcaagagcctgacgctgaacctcatcaccgagatgggccgcctgcccaccttcatgacccagaaggcccggaacgccctggacaacctcgcggtgctgcacacggccgaggccgggggccgcgcctacaaccacgccctgtccgagctccccgagaccctggagaccctgctcctgctgaccctcctggcgacggtgaccgggggcatcttcctgttcctcatgagcggcaaggggatcggcaagatgaccctggggatgtgctgcatcatcaccgcctccatcctgctctggtacgcccagatccagccgcactggatcgccgccagcatcatcctggagttcttcctgatcgtcctcctgatccccgagcccgagaagcagcggacgccccaggacaaccagctgacgtacgtggtgatcgcgatcctcaccgtcgtggccgccaccatggccaacgagatgggcttcctggagaagaccaagaaggacttcgggctgggctccatcacgacccagcagctcgagagcaacatcctggacatcgacctgcgcccggccagcgcgtggaccctctacgccgtggccaccacgttcatcacccccatgctgcggcactccatcgagaacagctccgtcaacgtgagcctgaccgccatcgccaaccaggcgaccgtgctcatgggcctggggaagggctggcccctgtccaagatggacatcggggtccccctcctggccatcggctgctacagccaggtgaacccgatcacgctgaccgccgccctcctgctgctcgtggcgcactacgccatcatcgggcccggcctgcaggccaaggccacccgcgaggcccagaagcgggcggccgccggcatcatgaagaaccccaccgtcgacgggatcacggtgatcgacctggaccccatcccgtacgaccccaagttcgagaagcagctcggccaggtgatgctgctggtcctctgcgtgacccaggtgctgatgatgcgcaccacctgggccctgtgcgaggccctcacgctggcgaccgggcccatctccaccctgtgggagggcaaccccgggcgcttctggaacaccacgatcgccgtcagcatggccaacatcttccggggctcctacctcgccggcgccgggctgctgttcagcatcatgaagaacaccgcgaacacccgccggggcaccgggaacacgggcgagaccctcggcgagaagtggaagaaccgcctgaacgccctggggaagtccgagttccagatctacaagaagtccggcatccaggaggtggaccggaccctcgccaaggaggggatcaagcgcggcgagaccgaccaccacgccgtgtcccgggggagcgcgaagctgcgctggttcgtcgagcggaacctggtgacgccggagggcaaggtggtcgacctcggctgcgggcgcggcgggtggtcctactactgcggcgggctgaagaacgtgaaggaggtgaagggcctgaccaagggcgggcccggccacgaggagcccatccccatgagcacctacgggtggaacctcgtccggctgcagtccggcgtggacgtgttcttcaccccgcccgagaagtgcgacacgctgctctgcgacatcggggagagctcccccaaccccaccgtcgaggccggccgcaccctgcgggtgctgaacctcgtggagaactggctgaacaacaacacccagttctgcatcaaggtcctgaacccgtacatgcccagcgtgatcgagaagatggaggccctgcagcgcaagtacggcggggccctcgtgcggaaccccctgagccgcaactccacccacgagatgtactgggtcagcaacgcctccggcaacatcgtgagctccgtgaacatgatcagccggatgctgatcaaccgcttcacgatgcggcacaagaaggcgacctacgagccggacgtcgacctcgggtccggcacccgcaacatcgggatcgagagcgagacccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtggtccggctgctcacgaagccctgggacgtgatcccgatggtgacccagatggccatgaccgacaccacgcccttcgggcagcagcgcgtcttcaaggagaaggtggacacccggacccaggagcccaaggagggcaccaagaagctgatgaagatcacggccgagtggctgtggaaggagctcggcaagaagaagacgccccggatgtgcacccgggaggagttcacccgcaaggtccggagcaacgcggccctgggggccatcttcacggacgagaacaagtggaagtccgcccgcgaggccgtggaggacagcggcttctgggagctggtggacaaggagcggaacctccacctggaggggaagtgcgagacctgcgtctacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggagaactccctgagcggggtggagggcgaggggctgcacaagctcggctacatcctgcgcgacgtgagcaagaaggagggcggggcgatgtacgccgacgacaccgccggctgggacacccggatcacgctggaggacctcaagaacgaggagatggtcaccaaccacatggagggggagcacaagcgcctggccgaggccatcttccggctgacctaccagaacaaggtggtgcgcgtccagcggccgacgccccggggcacggtgatggacatcatctcccggcgcgaccagcgcgggagcggccaggtggtcacctacggcctcaacaccttcaccaacatggaggcgcagctgatccggcagatggagggggagggcgtgttcaagtccatccagcacctgacggtgaccgaggagatcgccgtcaagaactggctcgcccgcgtggggcgggagcgcctgagccggatggccatctccggcgacgactgcgtggtcaagcccctggacgaccgcttcgccagcgcgctcaccgccctgaacgacatgggcaaggtgcggaaggacatccagcagtgggagccctcccgcgggtggaacgactggacccaggtgccgttctgcagccaccacttccacgagctgatcatgaaggacggccgggtcctcgtggtgccctgccgcaaccaggacgagctgatcgggcgggcccgcatctcccagggcgccgggtggagcctgcgggagacggcctgcctcggcaagtcctacgcgcagatgtggagcctgatgtacttccaccgccgggacctgcgcctcgccgccaacgccatctgctccgccgtccccagccactgggtgcccacctcccggaccacctggagcatccacgcgacccacgagtggatgacgaccgaggacatgctgaccgtgtggaaccgcgtctggatccaggagaacccgtggatggaggacaagacccccgtggagtcctgggaggagatcccctacctgggcaagcgggaggaccagtggtgcgggagcctcatcggcctgacgagccgcgccacctgggccaagaacatccagaccgccatcaaccaggtgcgctccctgatcgggaacgaggagtacaccgactacatgcccagcatgaagcggttccgccgggaggaggaggaggcgggcgtcctctggtga

SEQ ID NO: 9692 - RNA, 9876 nt, synthetic construct
  misc_feature 1..9876: note = derived and/or modified CDS sequence (opt1) from DENV-2__KC762678__SS-prME
  source 1..9876: mol_type = other RNA
accgccggcatcatcatcatgatgatccccaccgtcatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctgggtcctccgccaccccgggttcaccatcatggcggccatcctggcctacaccatcggcaccacctacttccagcggatcctgatcttcatcctcctgacggccgtgaccccctccatgaccatgcgctgcatcgggatcagcaaccgggacttcgtggagggcgtctccggcgggagctgggtggacatcgtgctggagcacggctcctgcgtcaccacgatggcgaagaacaagcccaccctcgacttcgagctgatcaagaccgaggccaagcaccccgccaccctgcgcaagtactgcatcgaggccaagctcacgaacaccaccaccgccagccggtgcccgacgcagggggagccctccctgaacgaggagcaggacaagcgcttcgtgtgcaagcacagcatggtggaccggggctggggcaacgggtgcggcctgttcgggaagggcgggatcgtgacctgcgcgatgttcacgtgcaagaagaacatggagggcaagatcgtgcagcccgagaacctcgagtacaccatcgtgatcacgccccactccggcgaggagaacgccgtcgggaacgacaccggcaagcacgggaaggagatcaaggtgaccccgcagagctccatcaccgaggccgagctgaccggctacgggacggtgaccatggagtgcagcccccgcaccggcctggacttcaacgagatggtcctcctgcagatggagaacaaggcctggctggtgcaccggcagtggttcctcgacctgcccctgccctggctcccgggcgccgacacccaggggtccaactggatccagaaggagacgctggtgaccttcaagaacccccacgcgaagaagcaggacgtcgtggtcctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtgaaggagatcgccgagacccagcacggcacgatcgtcatccgcgtgcagtacgagggggacggcagcccctgcaagatccccttcgagatcatggacctggagaagcggcacgtgctgggccgcctcatcaccgtcaacccgatcgtgaccgagaaggactcccccgtgaacatcgaggcggagccgcccttcggggacagctacatcatcatcggcgtcgagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggccctgcaccaggtgttcggggcgatctacggcgccgccttcagcggcgtctcctggaccatgaagatcctcatcggggtggtgatcacgtggatcggcatgaacagccgctccaccagcctgtccgtcagcctggtgctggtgggggtcgtgaccctctacctgggcgtgatggtccaggccgactccgggtgcgtggtgagctggaagaacaaggagctgaagtgcggcagcggcatcttcatcaccgacaacgtccacacgtggaccgagcagtacaagttccagcccgagtcccccagcaagctcgcgtccgccatccagaaggcccacgaggaggggatctgcggcatccggagcgtgacccgcctggagaacctgatgtggaagcagatcacccccgagctcaaccacatcctgtccgagaacgaggtgaagctgacgatcatgaccggggacatcaagggcatcatgcaggccgggaagcggagcctccgcccgcagcccaccgagctgaagtactcctggaagacctggggcaaggccaagatgctgagcacggagctccacaaccacaccttcctgatcgacggccccgagaccgcggagtgcccgaacgccaaccgggcctggaactccctggaggtcgaggactacgggttcggcgtgttcaccacgaacatctggctcaagctgaaggagcgccaggacgccttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacgggcagatcgacaacttcagcctcggcgtgctgggcatggcgctgttcctcgaggagatgctgcgcacccgggtcgggaccaagcacgccatcctgctcgtggccgtgtccttcgtcaccctgatcacgggcaacatgagcttccgcgacctggggcgcgtgatggtgatggtcggcgccaccatgaccgacgacatcgggatcggcgtgacctacctcgccctgctggcggccttcaaggtgcggcccacgttcgccgccggcctcctgctgcgcaagctcacctccaaggagctgatgatgaccaccatcgggatcacgctgctcagccagtccaccatccccgagaccatcctggagctgaccgacgccctcgcgctgggcatgatggtcctgaagatcgtgcggaacatggagaagtaccagctcgccgtgacgatcatggccatcctgtgcgtcccgaacgccgtgatcctgcagaacgcctggaaggtcagctgcaccaccctcgcggtggtgtccgtcagccccctgctgctcacctccagccagcagaaggccgactggatccccctggccctgacgatcaaggggctcaaccccaccgccatcttcctgaccaccctgtcccgcacgagcaagaagcggtcctggccgctcaacgaggcgatcatggccgtgggcatggtgagcatcctggcctccagcctgctcaagaacgacatccccatgaccggccccctggtcgccgggggcctgctcaccgtgtgctacgtgctgaccgggcgcagcgccgacctggagctcgagcgggcggccgacgtccgctgggaggagcaggccgagatctccggcagctcccccatcctgagcatcacgatctccgaggacgggagcatgtccatcaagaacgaggaggaggagcagaccctgaccatcctcatccggaccggcctgctggtgatcagcggcctcttcccggtgtccatccccatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgccggcgtgtacaaggaggggacgttccacaccatgtggcacgtgacccgcggcgcggtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggctgttcaagacgagcaccggcaccatcggggccgtgtccctggacttcagccccggcacctccggcagccccatcgtcgacaagaaggggaaggtggtgggcctctacgggaacggcgtcgtgacgcggtccggcacctacgtgagcgcgatcgcccagaccgagaagtccatcgaggacaaccccgagatcgaggacgacatcttccgcaagaagcggctgaccatcatggacctgcaccccggggccggcaagacgaagcgctacctgcccgccatcgtccgggaggcgatcaagcgcgggctccggaccctgatcctggccccgacccgcgtggtggccgccgagatggaggaggccctccgcggcctgcccatccggtaccagacccccgcgatccgcgccgagcacacggggcgggagatcgtcgacctgatgtgccacgccaccttcaccatgcgcctcctgtcccccatccgggtgccgaactacaacctgatcatcatggacgaggcccacttcaccgaccccgccagcatcgcggcccgcggctacatctccacgcgggtggagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtcaccgacttcaagggcaagacggtgtggttcgtgccgagcatcaaggccgggaacgacatcgccgcctgcctccggaagaacggcaagaaggtcatccagctgtcccgcaagaccttcgacagcgagtacatcaagacccggaccaacgactgggacttcgtggtgacgaccgacatctccgagatgggcgcgaacttcaaggccgagcgcgtcatcgacccccggcgctgcatgaagcccgtgatcctgaccgacggggaggagcgggtgatcctcgccggccccatgccggtcacccacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacgcccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcctaccgggtggcggccgaggggatcaactacgccgaccgccggtggtgcttcgacggcgtcaagaacaaccagatcctggaggagaacgtggaggtcgagatctggaccaaggagggggagcgcaagaagctcaagccgcggtggctggacgcccgcatctactccgaccccctggccctcaaggagttcaaggagttcgcggccggccgcaagagcctgaccctgaacctcatcacggagatgggccgcctgcccaccttcatgacccagaaggtgcggaacgccctggacaacctcgccgtgctgcacaccgcggaggccgggggccgcgcctacaaccacgccctgtccgagctccccgagacgctggagaccctgctcctgctgaccctcctggccaccgtcaccgggggcatcttcctgttcctcatgagcggcaagggggtgggcaagatgacgctggggatgtgctgcatcatcaccgcgtccatcctgctctggtacgcccagatccagccgcactggatcgccgccagcatcatcctggagttcttcctgatcgtgctcctgatccccgagcccgagaagcagcggacgccccaggacaaccagctgacctacgtcgtgatcgccatcctcacggtggtcgcggccaccatggccaacgagatgggcttcctggagaagaccaagaaggacttcgggctgggcagcatcaccacgcagcagccggagtccaacatcctcgacatcgacctgcgccccgccagcgcctggaccctgtacgcggtggccaccaccttcatcacgcccatgctccggcactccatcgagaacagctccgtgaacgtcagcctgaccgccatcgccaaccaggccaccgtgctgatgggcctcgggaagggctggcccctgtccaagatggacatcggggtgccgctgctcgcgatcggctgctacagccaggtcaaccccatcaccctgacggccgccctgctcctgctggtggcccactacgcgatcatcgggcccggcctccaggccaaggccacccgcgaggcccagaagcggaccgccgcgggcatcatgaagaaccccaccgtggacgggatcacggtcatcgacctggacccgatcccctacgaccccaagttcgagaagcagctgggccaggtgatgctcctggtgctgtgcgtcacccaggtgctcatgatgcgcaccacctgggccctgtgcgaggccctgacgctcgccaccgggcccatctccaccctgtgggagggcaacccggggcgcttctggaacaccacgatcgccgtgagcatggcgaacatcttccggggctcctacctggccggcgccgggctcctgttcagcatcatgaagaacaccgccaacacccgccggggcaccgggaacacgggcgagaccctgggcgagaagtggaagaaccgcctcaacgccctggggaagtccgagttccagatctacaagaagtccggcatccaggaggtcgaccggaccctggcgaaggaggggatcaagcgcggcgagaccgaccaccacgccgtgtcccgggggagcgccaagctccgctggttcgtggagcggaacctggtcacgcccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacctacgggtggaacctggtgcggctccagtccggcgtcgacgtgttcttcacgccgcccgagaagtgcgacaccctgctgtgcgacatcggggagagcagccccaacccgacggtggaggccggccgcaccctccgggtcctgaacctggtggagaactggctcaacaacaacacccagttctgcatcaaggtgctgtccccctacatgcccagcgtcatcgagaagatggaggcgctgcagcgcaagtacggcggggccctggtgcggaacccgctctcccgcaacagcacccacgagatgtactgggtgtccaacgccagcggcaacatcgtctccagcgtgaacatgatctcccggatgctgatcaaccgcttcacgatgcggcacaagaaggccacctacgagcccgacgtggacctggggagcggcacccgcaacatcgggatcgagtccgagacccccaacctcgacatcatcggcaagcgcatcgagaagatcaagcaggagcacgagacgagctggcactacgaccaggaccacccctacaagacctgggcctaccacggctcctacgagaccaagcagaccgggagcgcgtccagcatggtcaacggcgtggtgcggctgctgacgaagccgtgggacgtcatccccatggtgacccagatggccatgaccgacaccacgcccttcgggcagcagcgcgtgttcaaggagaaggtcgacacccggacccaggagcccaaggagggcaccaagaagctcatgaagatcacggccgagtggctgtggaaggagctgggcaagaagaagaccccgcgcatgtgcacccgggaggagttcacccgcaaggtgcggtccaacgccgccctcggggcgatcttcacggacgagaacaagtggaagtccgcccgcgaggccgtcgaggactccggcttctgggagctggtggacaaggagcggaacctgcacctcgaggggaagtgcgagacctgcgtgtacaacatgatgggcaagcgcgagaagaagctgggggagttcggcaaggccaagggcagccgggccatctggtacatgtggctgggggcgcgcttcctcgagttcgaggccctgggcttcctgaacgaggaccactggttcagccgggagaactccctcagcggggtcgagggcgaggggctgcacaagctgggctacatcctccgcgacgtgtccaagaaggagggcggggccatgtacgccgacgacaccgcgggctgggacacccggatcacgctggaggacctgaagaacgaggagatggtgaccaaccacatggagggggagcacaagaagctcgccgaggccatcttcaagctgacctaccagaacaaggtcgtgcgcgtgcagcggcccacgccccggggcacggtcatggacatcatcagccggcgcgaccagcgggggtccggccaggtggtgacctacggcctgaacaccttcaccaacatggaggcccagctcatccgccagatggagggggagggcgtcttcaagagcatccagcagctgacggtgaccgaggagatcgccgtgaagaactggctggtcaccgtggggcgcgagcggctctcccgcatggcgatcagcggcgacgactgcgtggtcaagcccctggacgaccggttcgcctccgccctgaccgccctcaacgacatgggcaaggtgcgcaaggacatccagcagtgggagccgagccgggggtggaacgactggacccaggtgcccttctgctcccaccacttccacgagctgatcatgaaggacggccgcgtcctggtggtgccctgccggaaccaggacgagctcatcgggcgcgcccggatcagccagggcgcggggtggtccctgcgcgagacggcctgcctgggcaagagctacgcccagatgtggtccctcatgtacttccaccggcgcgacctgcggctggccgccaacgcgatctgcagcgccgtcccctcccactgggtgccgaccagccgcaccacctggagcatccacgccacgcacgagtggatgaccaccgaggacatgctcaccgtgtggaaccgggtctggatccaggagaacccctggatggaggacaagacgcccgtggagtcctgggaggagatcccctacctgggcaagcgcgaggaccagtggtgcgggagcctgatcggcctcacctcccgggccacctgggccaagaacatccagaccgcgatcaaccaggtgcgcagcctgatcgggaacgaggagtacacggactacatgccgtccatgaagcggttccgccgcgaggaggaggaggccggcgtcctgtggtga

SEQ ID NO: 9693 - RNA, 9876 nt, synthetic construct
  misc_feature 1..9876: note = derived and/or modified CDS sequence (opt1) from DENV-2__KC762679__SS-prME
  source 1..9876: mol_type = other RNA
accgccggcatcatcatcatgatgatccccaccgtgatggccttccacctgaccacccggaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggtacgtcctgggccgcctcatcacggtgaacccgatcgtgaccgagaaggactcccccgtcaacatcgaggccgagccgcccttcggggacagctacatcatcatcggcgtggagccggggcagctgaagctgaactggttcaagaagggctccagcatcgggcagatgttcgagaccaccatgcgcggcgccaagcggatggccatcctcggcgacacggcctgggacttcgggtccctgggcggggtgttcaccagcatcggcaaggcgctgcaccaggtcttcggggccatctacggcgccgccttctccggcgtgagctggaccatgaagatcctcatcggggtggtcatcacctggatcggcatgaactcccgcagcacgtccctgagcgtgtccctggtgctggtcggggtggtgaccctctacctgggcgtcatggtgcaggcggacagcgggtgcgtggtctcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtgacccgcctggagaacctgatgtggaagcagatcacccccgagctcaaccacatcctgagcgagaacgaggtcaagctgaccatcatgacgggggacatcaagggcatcatgcaggccgggaagcggtccctccgcccgcagcccaccgagctgaagtacagctggaaggcgtggggcaaggccaagatgctgtccaccgagctccacaaccacaccttcctgatcgacggccccgagacggccgagtgcccgaacaccaaccgggcctggaacagcctggaggtggaggactacgggttcggcgtgttcaccaccaacatctggctcaagctgaaggagcgccaggacgtcttctgcgactccaagctgatgagcgccgcgatcaaggactcccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcaccacggtggtcgtgaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcaccgccggccacgggcagatcgacaacttcagcctcggcgtgctgggcatggcgctgttcctcgaggagatgctgcgcacgcgggtggggaccaagcacgccatcctgctcgtcgccgtgtccttcgtgaccctgatcaccggcaacatgagcttccgcgacctggggcgcgtcatggtgatggtgggcgccacgatgaccgacgacatcgggatgggcgtcacctacctcgccctgctggcggccttcaaggtgcggcccaccttcgccgccggcctcctgctgcgcaagctcacgtccaaggagctgatgatgaccaccatcgggatcgtgctgctcagccaggccaccatccccgagacgatcctggagctgaccgacgcgctcgccctgggcatgatggtcctgaagatcgtgcggaacatggagaagtaccagctcgccgtcaccatcatggccatcctgtgcgtgccgaacgccgtgatcctgcagaacgcgtggaaggtctcctgcaccacgctcgccgtggtgagcgtcagccccctgctgctcaccagctcccagcagaaggccgactggatccccctggccctgaccatcaaggggctcaaccccaccgcgatcttcctgacgaccctgagccgcacctccaagaagcggagctggccgctcaacgaggccatcatggccgtgggcatggtgtccatcctggccagctccctgctcaagaacgacatccccatgaccggccccctggtcgccgggggcctgctcacggtgtgctacgtgctgaccgggcgcagcgcggacctggagctcgagcgggccgccgacgtccgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttcccggtgagcatccccatcaccgccgcggcctggtacctgtgggaggtcaagaagcagcgcgccggggtgctgtgggacgtgcccagcccgccgcccgtcggcaaggccgagctcgaggacggggcctaccggatcaagcagaagggcatcctggggtacagccagatcggcgcgggcgtgtacaaggaggggaccttccacaccatgtggcacgtgacgcgcggcgccgtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggcggtgtccctggacttcagccccggcacctccggcagccccatcgtcgacaagaaggggaaggtggtgggcctctacgggaacggcgtcgtgacccggtccggcacctacgtgagcgccatcgcccagacggagaagtccatcgaggacaaccccgagatcgaggacgacatcttccgcaagaagcggctgaccatcatggacctgcaccccggggccggcaagaccaagcgctacctgcccgcgatcgtccgggaggccatcaagcgcgggctccggaccctgatcctggccccgacgcgcgtggtggccgccgagatggaggaggcgctccgcggcctgcccatccggtaccagacccccgccatccgcgccgagcacaccgggcgggagatcgtcgacctgatgtgccacgccaccttcacgatgcgcctcctgagccccatccgggtgccgaactacaacctgatcatcatggacgaggcccacttcaccgaccccgcgagcatcgccgcccgcggctacatctccacccgggtggagatgggcgaggccgccgggatcttcatgaccgcgacgccgcccggcagccgcgacccgttcccccagtccaacgcccccatcatggacgaggagcgggagatccccgagcgcagctggaactccgggcacgagtgggtcaccgacttcaagggcaagaccgtgtggttcgtgccgagcatcaaggccgggaacgacatcgccgcgtgcctccggaagaacggcaagaaggtcatccagctgtcccgcaagaccttcgacagcgagtacatcaagacgcggaccaacgactgggacttcgtggtgaccaccgacatctccgagatgggcgccaacttcaaggccgagcgcgtcatcgacccccggcgctgcatgaagcccgtgatcctgacggacggggaggagcgggtgatcctcgccggccccatgccggtcacccacagctccgccgcgcagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcgtaccgggtcgccgccgaggggatcaactacgccgaccgccggtggtgcttcgacggcgtgaagaacaaccagatcctggaggagaacgtggaggtcgagatctggacgaaggagggggagcgcaagaagctcaagccgcggtggctggacgcccgcatctactccgaccccctggcgctcaaggagttcaaggagttcgccgccggccggaagtccctgaccctgaacctcatcaccgagatgggccgcctgcccaccttcatgacgcagaaggcccggaacgcgctggacaacctcgccgtgctgcacaccgccgaggccgggggccgcgcctacaaccacgcgctgtccgagctccccgagaccctggagaccctgctcctgctgacgctcctggccaccgtgaccgggggcatcttcctgttcctcatgagcggcaaggggatcggcaagatgaccctggggatgtgctgcatcatcaccgcctccatcctgctctggtacgcccagatccagccgcactggatcgccgcgagcatcatcctggagttcttcctgatcgtcctcctgatccccgagcccgagaagcagcggacgccccaggacaaccagctgacctacgtggtgatcgccatcctcaccgtcgtggccgccaccatggccaacgagatgggcttcctggagaagacgaagaaggacttcgggctgggctccatcaccacccagcagccggagagcaacatcctcgacatcgacctgcgccccgcgagcgcctggaccctgtacgccgtggccacgaccttcatcacccccatgctccggcactccatcgagaacagctccgtcaacgtgagcctgaccgccatcgcgaaccaggccacggtgctgatgggcctcgggaagggctggcccctgtccaagatggacatcggggtcccgctgctcgccatcggctgctacagccaggtgaaccccatcaccctgaccgccgcgctgctcctgctggtggcccactacgccatcatcgggcccggcctccaggccaaggccacccgcgaggcgcagaagcgggccgccgccggcatcatgaagaaccccacggtcgacgggatcaccgtgatcgacctggacccgatcccctacgaccccaagttcgagaagcagctgggccaggtgatgctcctggtcctgtgcgtgacccaggtgctcatgatgcgcaccacgtgggccctgtgcgaggcgctgaccctcgccaccgggcccatctccaccctgtgggagggcaacccggggcgcttctggaacacgaccatcgccgtcagcatggccaacatcttccggggctcctacctggccggcgcggggctcctgttcagcatcatgaagaacaccgccaacacccgccggggcacggggaacaccggcgagaccctgggcgagaagtggaagaaccgcctcaacgccctggggaagtccgagttccagatctacaagaagtccggcatccaggaggtggaccggaccctggccaaggaggggatcaagcgcggcgagacggaccaccacgcggtgtcccgggggagcgccaagctccgctggttcgtcgagcggaacctggtgacccccgagggcaaggtggtcgacctgggctgcgggcgcggcgggtggtcctactactgcggcgggctcaagaacgtgaaggaggtgaagggcctgaccaagggcgggcccggccacgaggagcccatcccgatgagcacctacgggtggaacctggtccggctccagtccggcgtggacgtgttcttcacgccgcccgagaagtgcgacaccctgctgtgcgacatcggggagagctcccccaacccgaccgtcgaggccggccgcaccctccgggtgctgaacctggtggagaactggctcaacaacaacacccagttctgcatcaaggtcctgaacccctacatgcccagcgtgatcgagaagatggaggccctgcagcgcaagtacggcggggccctggtgcggaacccgctcagccgcaactccacgcacgagatgtactgggtcagcaacgcgtccggcaacatcgtgagctccgtgaacatgatcagccggatgctgatcaaccgcttcaccatgcggcacaagaaggccacctacgagcccgacgtcgacctggggtccggcacccgcaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctgctgaccaagccgtgggacgtgatccccatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagaccccgcgcatgtgcacccgggaggagttcacgcgcaaggtccggagcaacgccgccctcggggccatcttcaccgacgagaacaagtggaagtccgcccgcgaggcggtggaggacagcggcttctgggagctggtggacaaggagcggaacctgcacctcgaggggaagtgcgagacctgcgtctacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaactccctcagcggggtggagggcgaggggctgcacaagctgggctacatcctccgcgacgtgagcatgaaggagggcggggccatgtacgccgacgacaccgccggctgggacacgcggatcaccctggaggacctgaagaacgaggagatggtcaccaaccacatggagggggagcacaagaagctcgccgaggcgatcttcaagctgacctaccagaacaaggtggtgcgcgtccagcggcccacgccccgcggcaccgtgatggacatcatctcccggcgcgaccagcgggggagcggccaggtggtcacctacggcctgaacaccttcacgaacatggaggcccagctcatccgccagatggagggggagggcgtgttcaagtccatccagcagctgaccgtgaccgaggagatcgccgtcaagaactggctggtgcgcgtggggcgggagcgcctcagccggatggccatctccggcgacgactgcgtcgtgaagcccctggacgaccgcttcgccagcgcgctgaccgccctcaacgacatgggcaaggtgcggaaggacatccagcagtgggagccgtcccgcgggtggaacgactggacgcaggtccccttctgcagccaccacttccacgagctgatcatgaaggacggccgggtgctggtggtcccctgccgcaaccaggacgagctcatcgggcgggcccgcatctcccagggcgccgggtggagcctgcgggagaccgcctgcctgggcaagtcctacgcgcagatgtggagcctcatgtacttccaccgccgggacctgcgcctggccgccaacgccatctgctccgccgtgcccagccactgggtgccgacctcccggaccacctggagcatccacgcgacgcacgagtggatgaccaccgaggacatgctcaccgtctggaaccgcgtgtggatccaggagaacccctggatggaggacaagacgcccgtggagtcctgggaggagatcccctacctgggcaagcgggaggaccagtggtgcgggagcctgatcggcctcaccagccgcgccacctgggccaagaacatccagaccgccatcaaccaggtccggtccctgatcgggaacgaggagtacacggactacatgccgagcatgaagcgcttccgccgggaggaggaggaggcgggcgtgctgtggtga

SEQ ID NO: 9694 - RNA, 9876 nt, synthetic construct
  misc_feature 1..9876: note = derived and/or modified CDS sequence (opt1) from DENV-2__KC762680__SS-prME
  source 1..9876: mol_type = other RNA
accgccggcatcatcatcatgatgatccccaccgtgatggccttccacctgaccacccggaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggtacgtcctgggccgcctcatcacggtgaacccgatcgtgaccgagaaggactcccccgtcaacatcgaggccgagccgcccttcggggacagctacatcatcatcggcgtggagccggggcagctgaagctgaactggttcaagaagggctccagcatcgggcagatgttcgagaccaccatgcgcggcgccaagcggatggccatcctcggcgacacggcctgggacttcgggtccctgggcggggtgttcaccagcatcggcaaggcgctgcaccaggtcttcggggccatctacggcgccgccttctccggcgtgagctggaccatgaagatcctcatcggggtggtcatcacctggatcggcatgaactcccgcagcacgtccctgagcgtgtccctggtgctggtcggggtggtgaccctctacctgggcgtcatggtgcaggcggacagcgggtgcgtggtctcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtgacccgcctggagaacctgatgtggaagcagatcacccccgagctcaaccacatcctgagcgagaacgaggtcaagctgaccatcatgacgggggacatcaagggcatcatgcaggccgggaagcggtccctccgcccgcagcccaccgagctgaagtacagctggaaggcgtggggcaaggccaagatgctgtccaccgagctccacaaccacaccttcctgatcgacggccccgagacggccgagtgcccgaacaccaaccgggcctggaacagcctggaggtggaggactacgggttcggcgtgttcaccaccaacatctggctcaagctgaaggagcgccaggacgtcttctgcgactccaagctgatgagcgccgcgatcaaggactcccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcaccacggtggtcgtgaccgaggactgcgggaaccgcggccccagcctgcggaccaccacggcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcaccgccggccacgggcagatcgacaacttcagcctcggcgtgctgggcatggcgctgttcctcgaggagatgctgcgcacgcgggtggggaccaagcacgccatcctgctcgtcgccgtgtccttcgtgaccctgatcaccggcaacatgagcttccgcgacctggggcgcgtcatggtgatggtgggcgccacgatgaccgacgacatcgggatgggcgtcacctacctcgccctgctggcggccttcaaggtgcggcccaccttcgccgccggcctcctgctgcgcaagctcacgtccaaggagctgatgatgaccaccatcgggatcgtgctgctcagccaggccaccatccccgagacgatcctggagctgaccgacgcgctcgccctgggcatgatggtcctgaagatcgtgcggaacatggagaagtaccagctcgccgtcaccatcatggccatcctgtgcgtgccgaacgccgtgatcctgcagaacgcgtggaaggtctcctgcaccacgctcgccgtggtgagcgtcagccccctgctgctcaccagctcccagcagaaggccgactggatccccctggccctgaccatcaaggggctcaaccccaccgcgatcttcctgacgaccctgagccgcacctccaagaagcggagctggccgctcaacgaggccatcatggccgtgggcatggtgtccatcctggccagctccctgctcaagaacgacatccccatgaccggccccctggtcgccgggggcctgctcacggtgtgctacgtgctgaccgggcgcagcgcggacctggagctcgagcgggccgccgacgtccgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttcccggtgagcatccccatcaccgccgcggcctggtacctgtgggaggtcaagaagcagcgcgccggggtgctgtgggacgtgcccagcccgccgcccgtcggcaaggccgagctcgaggacggggcctaccggatcaagcagaagggcatcctggggtacagccagatcggcgcgggcgtgtacaaggaggggaccttccacaccatgtggcacgtgacgcgcggcgccgtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggcggtgtccctggacttcagccccggcacctccggcagccccatcgtcgacaagaaggggaaggtggtgggcctctacgggaacggcgtcgtgacccggtccggcacctacgtgagcgccatcgcccagacggagaagtccatcgaggacaaccccgagatcgaggacgacatcttccgcaagaagcggctgaccatcatggacctgcaccccggggccggcaagaccaagcgctacctgcccgcgatcgtccgggaggccatcaagcgcgggctccggaccctgatcctggccccgacgcgcgtggtggccgccgagatggaggaggcgctccgcggcctgcccatccggtaccagacccccgccatccgcgccgagcacaccgggcgggagatcgtcgacctgatgtgccacgccaccttcacgatgcgcctcctgagccccatccgggtgccgaactacaacctgatcatcatggacgaggcccacttcaccgaccccgcgagcatcgccgcccgcggctacatctccacccgggtggagatgggcgaggccgccgggatcttcatgaccgcgacgccgcccggcagccgcgacccgttcccccagtccaacgcccccatcatggacgaggagcgggagatccccgagcgcagctggaactccgggcacgagtgggtcaccgacttcaagggcaagaccgtgtggttcgtgccgagcatcaaggccgggaacgacatcgccgcgtgcctccggaagaacggcaagaaggtcatccagctgtcccgcaagaccttcgacttcgagtacatcaagacgcggaccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgccggccccatgccggtcacccactccagcgccgcgcagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtcgacctgatgcggcgcggcgacctccccgtgtggctggcgtaccgggtcgccgccgaggggatcaactacgccgaccgccggtggtgcttcgacggcgtgaagaacaaccagatcctggaggagaacgtggaggtcgagatctggacgaaggagggggagcgcaagaagctcaagccgcggtggctggacgcccgcatctacagcgaccccctggcgctcaaggagttcaaggagttcgccgccggccggaagtccctgaccctgaacctcatcaccgagatgggccgcctgcccaccttcatgacgcagaaggcccggaacgcgctggacaacctcgccgtgctgcacaccgccgaggccgggggccgcgcctacaaccacgcgctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtcctcctgatccccgagcccgagaagcagcggacgccccaggacaaccagctgacctacgtggtgatcgccatcctcaccgtcgtggccgccaccatggccaacgagatgggcttcctggagaagacgaagaaggacttcgggctgggcagcatcaccacccagcagccggagtccaacatcctcgacatcgacctgcgccccgcgagcgcctggaccctgtacgccgtggccacgaccttcatcacccccatgctccggcacagcatcgagaactccagcgtcaacgtgtccctgaccgccatcgcgaaccaggccacggtgctgatgggcctcgggaagggctggcccctgagcaagatggacatcggggtcccgctgctcgccatcggctgctactcccaggtgaaccccatcaccctgaccgccgcgctgctcctgctggtggcccactacgccatcatcgggcccggcctccaggccaaggccacccgcgaggcgcagaagcgggccgccgccggcatcatgaagaaccccacggtcgacgggatcaccgtgatcgacctggacccgatcccctacgaccccaagttcgagaagcagctgggccaggtgatgctcctggtcctgtgcgtgacccaggtgctcatgatgcgcaccacgtgggccctgtgcgaggcgctgaccctcgccaccgggcccatcagcaccctgtgggagggcaacccggggcgcttctggaacacgaccatcgccgtctccatggccaacatcttccggggcagctacctggccggcgcggggctcctgttctccatcatgaagaacaccgccaacacccgccggggcacggggaacaccggcgagaccctgggcgagaagtggaagaaccgcctcaacgccctggggaagtccgagttccagatctacaagaagtccggcatccaggaggtggaccggaccctggccaaggaggggatcaagcgcggcgagacggaccaccacgcggtgagccgggggtccgccaagctccgctggttcgtcgagcggaacctggtgacccccgagggcaaggtggtcgacctgggctgcgggcgcggcgggtggagctactactgcggcgggctcaagaacgtgaaggaggtgaagggcctgaccaagggcgggcccggccacgaggagcccatcccgatgtccacctacgggtggaacctggtccggctccagagcggcgtggacgtgttcttcacgccgcccgagaagtgcgacaccctgctgtgcgacatcggggagtccagccccaacccgaccgtcgaggccggccgcaccctccgggtgctgaacctggtggagaactggctcaacaacaacacccagttctgcatcaaggtcctgaacccctacatgccctccgtgatcgagaagatggaggccctgcagcgcaagtacggcggggccctggtgcggaacccgctcagccgcaacagcacgcacgagatgtactgggtctccaacgcgagcggcaacatcgtgtccagcgtgaacatgatctcccggatgctgatcaaccgcttcaccatgcggcacaagaaggccacctacgagcccgacgtcgacctggggagcggcacccgcaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtggtccggctgctgaccaagccgtgggacgtgatccccatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagaccccgcgcatgtgcacccgggaggagttcacgcgcaaggtccggtccaacgccgccctcggggccatcttcaccgacgagaacaagtggaagtccgcccgcgaggcggtggaggactccggcttctgggagctggtggacaaggagcggaacctgcacctcgaggggaagtgcgagacctgcgtctacaacatgatgggcaagcgcgagaagaagctgggggagttcggcaaggccaagggcagccgggccatctggtacatgtggctgggggcccgcttcctcgagttcgaggcgctgggcttcctgaacgaggaccactggttctcccgggagaacagcctctccggggtggagggcgaggggctgcacaagctgggctacatcctccgcgacgtgagcatgaaggagggcggggccatgtacgccgacgacaccgccggctgggacacgcggatcaccctggaggacctgaagaacgaggagatggtcaccaaccacatggagggggagcacaagaagctcgccgaggcgatcttcaagctgacctaccagaacaaggtggtgcgcgtccagcggcccacgccccgcggcaccgtgatggacatcatcagccggcgcgaccagcgggggtccggccaggtggtcacctacggcctgaacaccttcacgaacatggaggcccagctcatccgccagatggagggggagggcgtgttcaagagcatccagcagctgaccgtgaccgaggagatcgccgtcaagaactggctggtgcgcgtggggcgggagcgcctctcccggatggccatcagcggcgacgactgcgtcgtgaagcccctggacgaccgcttcgcctccgcgctgaccgccctcaacgacatgggcaaggtgcggaaggacatccagcagtgggagccgagccgcgggtggaacgactggacgcaggtccccttctgctcccaccacttccacgagctgatcatgaaggacggccgggtgctggtggtcccctgccgcaaccaggacgagctcatcgggcgggcccgcatcagccagggcgccgggtggtccctgcgggagaccgcctgcctgggcaagagctacgcgcagatgtggtccctcatgtacttccaccgccgggacctgcgcctggccgccaacgccatctgcagcgccgtgccctcccactgggtgccgaccagccggaccacctggtccatccacgcgacgcacgagtggatgaccaccgaggacatgctcaccgtctggaaccgcgtgtggatccaggagaacccctggatggaggacaagacgcccgtggagagctgggaggagatcccctacctgggcaagcgggaggaccagtggtgcgggtccctgatcggcctcaccagccgcgccacctgggccaagaacatccagaccgccatcaaccaggtccggagcctgaaggggaacgaggagtacacggactacatgccgtccatgaagcgcttccgccgggaggagggcgaggcgggggtgctgtggtga

SEQ ID NO: 9695 - RNA, 9876 nt, synthetic construct
  misc_feature 1..9876: note = derived and/or modified CDS sequence (opt1) from DENV-2__JQ955624__SS-prME
  source 1..9876: mol_type = other RNA
accgccggcgtcatcatcatgctgatccccaccgccatggcgttccacctcaccacccggaacggggagccccacatgatcgtcagccggcaggagaagggcaagagcctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacagcaccagcacctgggtgacctacgggacctgcaccgccaccggcgagcaccggcgggagaagcggagcgtcgccctggtgccccacgtgggcatggggctcgagacccgcaccgagacctggatgtccagcgagggcgcctggaagcacgcgcagcggatcgagacctggatcctgcgccaccccgggttcgccatcatggccgccatcctggcgtacacgatcggcaccacccacttccagcgggtcctcatcttcatcctgctgaccgccgtggccccctccatgacgatgcgctgcatcgggatcagcaaccgggacttcgtggagggcgtctccggcgggagctgggtggacatcgtgctcgagcacggctcctgcgtcaccaccatggccaagaacaagcccaccctggacttcgagctgatcaagacggaggccaagcagcccgcgaccctccgcaagtactgcatcgaggccaagctgaccaacaccacgaccgccagccggtgcccgacccagggggagccctccctgaacgaggagcaggacaagcgcttcgtgtgcaagcacagcatggtggaccggggctggggcaacgggtgcggcctcttcgggaagggcgggatcgtgacctgcgccatgttcacgtgcaagaagaacatggagggcaagatcgtgcagcccgagaacctggagtacaccatcgtggtcacgccccactccggcgaggagaacgccgtggggaacgacaccggcaagcacgggaaggagatcaaggtgacgccgcagagctccatcaccgaggcggagctgaccggctacgggaccgtcaccatggagtgcagcccccgcacgggcctcgacttcaacgagatggtgctgctgcagatggagaacaaggcctggctcgtgcaccggcagtggttcctggacctgcccctcccctggctgccgggcgccgacacccaggggtccaactggatccagaaggagaccctggtcaccttcaagaacccccacgccaagaagcaggacgtggtcgtgctcggcagccaggagggggccatgcacacggcgctgaccggcgccaccgagatccagatgagctccgggaacctcctgttcaccggccacctgaagtgccgcctgcggatggacaagctccagctgaagggcatgagctactccatgtgcacggggaagttcaaggtggtcaaggagatcgccgagacccagcacggcaccatcgtggtgcgcgtccagtacgagggggacggcagcccctgcaagatccccttcgagatcatggacctggagaagcggcacgtgctcggccgcctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggcgatcctgggcgacaccgcctgggacttcgggagcctgggcggggtcttcacgtccatcggcaaggccctccaccaggtgttcggggccatctacggcgcggccttcagcggcgtgtcctggaccatgaagatcctgatcggggtcgtgatcacctggatcggcatgaacagccgctccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcgcacgaggaggggatctgcggcatccggagcgtcacgcgcctggagaacctcatgtggaagcagatcacccccgagctgaaccacatcctgtccgagaacgaggtgaagctcaccatcatgaccggggacatcaagggcatcatgcaggccgggaagcggagcctgcgcccgcagcccacggagctgaagtactcctggaagacctggggcaaggccaagatgctcagcaccgagtcccacaaccagaccttcctgatcgacggccccgagacgaccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcggtgaaggacaaccgggccgtccacgccgacatggggtactggatcgagtccgccctcaacgacacctggaagatcgagaaggccagcttcatcgaggtgaagtcctgccactggcccaagagccacaccctgtggtccaacggcgtgctggagagcgagatgatcatccccaagaacttcgcgggccccgtcagccagcacaactaccgcccggggtaccacacccagaccgccggcccctggcacctcgggaagctggagatggacttcgacttctgcgagggcacgaccgtggtggtcaccgaggactgcgggaaccggggcccctccctgcgcaccacgaccgccagcggcaagctcatcaccgagtggtgctgccggtcctgcaccctgcccccgctgcgctaccgcggggaggacggctgctggtacgggatggagatccgccccctcaaggagaaggaggagaacctggtgaacagcctggtgacggccggccacgggcagatcgacaacttctccctcggcatcctgggcatggcgctgttcctcgaggagatgctgcggacccgcgtcgggaccaagcacgccgtgctgctcgtggccgtcagcttcatgaccctgatcacgggcaacatgtccttccgggacctggggcgcgtgatggtgatggtcggcgccgccatgaccgacgacatcgggatgggcgtgacctacctcgcgctgctggccgccttcaaggtgcgccccaccttcgccgccggcctcctgctgcggaagctcacgagcaaggagctgatgatgaccaccatcgggatcgtcctgctctcccagagcaccatccccgagacgatcctggagctgaccgacgcgctcgccctgggcatgatggtgctgaagatcgtccgcaacatggagaagtaccagctcgccgtgaccatcatggccatcctgtgcgtgccgaacgccgtcatcctgcagaacgcgtggaaggtgtcctgcaccatcctcgccgtggtcagcgtgagccccctgctgctcacgagctcccagcagaaggccgactggatccccctggccctgaccatcaaggggctcaaccccaccgcgatcttcctgaccacgctgagccggaccaacaagaagcgctcctggccgctcaacgaggccatcatggccgtgggcatggtcagcatcctggcctccagcctgctcaagaacgacatccccatgaccggccccctggtggccgggggcctgctcaccgtgtgctacgtcctgacggggcggagcgcggacctggagctcgagcgcgccgccgacgtgcggtgggaggaccaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtctccatccccatcaccgccgcggcctggtacctgtgggaggtgaagaagcagcgggccggggtgctgtgggacgtcccctccccgccgcccgtgggcaaggccgagctcgaggacggggcctaccgcatcaagcagaagggcatcctggggtactcccagatcggcgcgggcgtgtacaaggaggggaccttccacaccatgtggcacgtcacccggggcgccgtgctgatgcacaaggggaagcgcatcgagcccagctgggccgacgtgcggaaggacctcatctcctacggcgggggctggaagctggagggcgagtggaaggagggggaggaggtccaggtgctggccctcgagcccggcaagaacccccgcgccgtgcagacgaagcccgggctgttcaagaccaacaccggcaccatcggggcggtcagcctggacttctcccccggcacgagcggctcccccatcgtggacaagaaggggaaggtggtcggcctctacgggaacggcgtggtgacccggagcggcacctacgtctccgccatcgcccagagcgagaagtccatcgaggacaaccccgagatcgaggacgacatcttccgcaagaagcggctgaccatcatggacctgcaccccggggccggcaagacgaagcgctacctgcccgcgatcgtgcgggaggccatcaagcgcgggctccggaccctgatcctggccccgacccgcgtggtcgccgccgagatggaggaggcgctccgcggcctgcccatccggtaccagacccccgccatccgcgccgagcacacggggcgggagatcgtggacctgatgtgccacgccaccttcaccatgcgcctcctgtcccccgtgcgggtcccgaactacaacctgatcatcatggacgaggcccacttcaccgaccccgcgagcatcgccgcccgcggctacatctccacgcgggtggagatgggcgaggccgccgggatcttcatgaccgcgacgccgcccggcagccgcgacccgttcccccagtccaacgcccccatcatggacgaggagcgggagatccccgagcgcagctggaactccgggcacgagtgggtgaccgacttcaagggcaagacggtctggttcgtgccgagcatcaaggccgggaacgacatcgccgcgtgcctccggaagaacggcaagaaggtgatccagctgtcccgcaagaccttcgacagcgagtacatcaagacccggaccaacgactgggacttcgtcgtgacgaccgacatctccgagatgggcgccaacttcaaggccgagcgcgtgatcgacccccggcgctgcatgaagcccgtcatcctgaccgacggggaggagcgggtgatcctcgccggccccatgccggtgacccacagctccgccgcgcagcgccgggggcgcatcggccgcaaccccaagaacgagaacgaccagtacatctacatgggggagcccctggagaacgacgaggactgcgcccactggaaggaggccaagatgctgctcgacaacatcaacacgcccgagggcatcatcccgagcatgttcgagcccgagcgggagaaggtcgacgccatcgacggcgagtaccgcctgcgcggggaggcccgcaagaccttcgtggagctgatgcggcgcggcgacctccccgtctggctggcgtaccgggtggccgccgaggggatcaactacgccgaccgccggtggtgcttcgacggcatcaagaacaaccagatcctggaggagaacgtggaggtcgagatctggaccaaggagggggagcgcaagaagctcaagccgcggtggctggacgcccgcatctactccgaccccctggcgctcaaggagttcaaggagttcgccgccggccgcaagagcctgaccctgaacctcatcacggagatgggccgcctgcccaccttcatgacccagaaggcccggaacgcgctggacaacctcgccgtgctgcacaccgccgaggccgggggccgcgcctacaaccacgcgctgtccgagctccccgagacgctggagaccctgctcctgctgaccctcctggccaccgtgaccggcgggatcttcctgttcctcatgagcgggaaggggatcggcaagatgaccctggggatgtgctgcatcatcaccgcctccatcctgctctggtacgcccagatccagccgcactggatcgccgcgagcatcatcctggagttcttcctgatcgtcctcctgatccccgagcccgagaagcagcggacgccccaggacaaccagctgacctacgtggtgatcgccatcctcacggtcgtggccgccaccatggccaacgagatgggcttcctggagaagaccaagaaggacttcgggttcggcagcatcgcgacccagcagccggagtccaacatcctggacatcgacctccgccccgccagcgcctggacgctgtacgccgtggccaccaccttcatcacccccatgctgcggcactccatcgagaacagctccgtcaacgtgagcctcacggcgatcgccaaccaggccaccgtgctgatgggcctggggaagggctggcccctctccaagatggacatcggggtcccgctgctggccatcggctgctacagccaggtgaaccccatcaccctcaccgcggccctgctgctcctggtggcccactacgccatcatcgggcccggcctgcaggccaaggcgacgcgcgaggcccagaagcgggccgccgccggcatcatgaagaaccccaccgtcgacgggatcaccgtgatcgacctcgacccgatcccctacgaccccaagttcgagaagcagctgggccaggtgatgctgctcgtcctgtgcgtgacccaggtgctgatgatgcgcacgacctgggcgctctgcgaggccctgaccctggccaccgggcccatctccacgctctgggagggcaacccggggcgcttctggaacaccaccatcgccgtcagcatggccaacatcttccggggctcctacctggcgggcgccgggctcctgttcagcatcatgaagaacaccacgaacacccgccggggcaccgggaacaccggcgagacgctgggcgagaagtggaagaaccgcctgaactccctcggcaagagcgagttccagatctacaagcggtccggcatccaggaggtggaccgcaccctggccaaggaggggatcaagcggggcgagaccgaccaccacgccgtgagccgcgggtccgcgaagctgcggtggttcgtcgagcgcaacctcgtgacccccgagggcaaggtgatggacctgggctgcgggcggggcgggtggagctactactgcggcgggctgaagaacgtccgcgaggtgaagggcctcacgaagggcgggcccggccacgaggagcccatcccgatgtccacctacgggtggaacctggtgcggctgcagagcggcgtcgacgtgttcttcacgccgcccgagaagtgcgacaccctcctgtgcgacatcggggagagctcccccaacccgacggtggaggccggccgcaccctgcgggtcctcaacctggtggagaactggctgaacaacaacacccagttctgcatcaaggtgctcaacccctacatgcccagcgtcatcgagaagatggagaccctgcagcgcaagtacggcggggccctggtgcggaacccgctgtcccgcaacagcacccacgagatgtactgggtgtccaacgccagcggcaacatcgtctccagcgtgaacatgatctcccggatgctcatcaaccgcttcacgatgcgccacaagaaggccacctacgagcccgacgtggacctggggagcggcacccggaacatcgggatcgagtccgagacccccaacctggacatcatcggcaagcgcatcgagaagatcaagcaggagcacgagacgagctggcactacgaccaggaccacccctacaagacctgggcgtaccacggctcctacgagaccaagcagaccgggagcgcctccagcatggtcaacggcgtggtgcggctcctgacgaagccgtgggacgtcatccccatggtgacccagatggccatgaccgacaccacgcccttcgggcagcagcgcgtgttcaaggagaaggtcgacacccggacccaggagcccaaggagggcaccaagaagctgatgaagatcacggccgagtggctctggaaggagctgggcaagaagaagaccccgcgcatgtgcacccgggaggagttcacccgcaaggtgcggtccaacgccgcgctgggggccatcttcacggacgagaacaagtggaagtccgcccgcgaggccgtcgaggactcccggttctgggagctcgtggacaaggagcgcaacctgcacctggagggcaagtgcgagacctgcgtgtacaacatgatggggaagcgggagaagaagatgggcgagttcgggaaggccaagggcagccgcgcgatctggtacatgtggctcggcgcccggttcctggagttcgaggccctggggttcctcaacgaggaccactggttcagccgcgagaactccctgagcggcgtcgagggggagggcctgcacaagctcgggtacatcctgcgggaggtgtccaagaaggagggcggcgccatgtacgcggacgacaccgccgggtgggacacccgcatcacgctggaggacctcaagaacgaggagatggtgaccaaccacatggagggcgagcacaagaagctggccgaggccatcttcaagctgacctaccagaacaaggtcgtgcgggtgcagcgccccacgccccgggggacggtcatggacatcatcagccgccgcgaccagcggggctccggccaggtggggacctacggcctcaacaccttcaccaacatgggggcccagctgatccgccagatggagggcgagggggtgttcaagagcatccagcacctgacgaccaccgaggaggtcgcggtgcaggactggctcgcccgggtgggccgcgagcggctgtcccgcatggccatcagcggcgacgactgcgtcgtgaagcccctggacgaccggttcgcctccgccctcaccgcgctgaacgacatggggaaggtgcgcaaggacatccagcagtgggagccgagccggggctggaacgactggacgcaggtccccttctgctcccaccacttccacgagctgatcatgaaggacgggcgcgtgctcgtggtcccctgccggaaccaggacgagctgatcggccgcgcccggatcagccagggggccggctggtccctgcgcgagaccgcctgcctcggcaagagctacgcccagatgtggtccctgatgtacttccaccggcgcgacctgcggctcgcggccaacgccatctgcagcgccgtgccctcccactgggtgccgaccagccgcaccacctggagcatccacgcccggcacgagtggatgacgaccgaggacatgctgaccgtctggaaccgcgtgtggatccaggagaacccctggatggaggacaagacccccgtggagtcctgggaggagatcccctacctggggaagcgcgaggaccagtggtgcggcagcctcatcgggctgacgtcccgggcgacctgggccaagaacatccagaccgccatcaaccaggtccgcagcctgatcggctccgaggagtacaccgactacatgccgagcatgaagcggttccgccgggaggaggaggaggccggggtgctctggtga

SEQ ID NO: 9696 - RNA, 9876 nt, synthetic construct
  misc_feature 1..9876: note = derived and/or modified CDS sequence (opt1) from DENV-2__KJ918750__SS-prME
  source 1..9876: mol_type = other RNA
accgcgggcatgatcatcatgctgatccccaccgtgatggccttccacctcaccacccgcaacggggagccccacatgatcgtgagccggcaggagaagggcaagagcctgctgttcaagaccaaggacgggaccaacatgtgcaccctcatggcgatggacctgggcgagctgtgcgaggacaccatcacctacaagtgccccttcctccgccagaacgagcccgaggacatcgactgctggtgcaacagcaccagcacctgggtgacctacgggacctgcaccaccaccggcgagcaccggcgcgagaagcggagcgtggccctggtcccccacgtgggcatggggctggagacccgcaccgagacgtggatgtccagcgagggcgcctggaagcacgcccagcggatcgagatctggatcctccgccacccggggttcaccatcatggccgcgatcctggcctacaccatcggcaccacgcacttccagcgggtgctgatcttcatcctcctgaccgccatcgccccctccatgaccatgcgctgcatcgggatcagcaaccgggacttcgtcgagggcgtgtccggcgggagctgggtggacatcgtcctggagcacggctcctgcgtgaccacgatggcgaagaacaagcccaccctcgacttcgagctgatcaagaccgaggccaagcagcccgccaccctgcgcaagtactgcatcgaggccaagctcacgaacaccaccaccgacagccggtgccccacgcagggggagcccaccctgaacgaggagcaggacaagcgcttcgtgtgcaagcactccatggtcgaccggggctggggcaacgggtgcggcctgttcgggaagggcgggatcgtgacctgcgccatgttcacgtgcaagaagatcatgaagggcaagatcgtgcagcccgagaacctcgagtacacggtcgtgatcacgccccacagcggcgaggagcacgcggtggggaacgacaccggcaagcacgggaaggaggtcaagatcaccccgcagtccagcatcaccgaggccgagctgacgggctacgggaccgtgaccatggagtgcagcccccggaccggcctggacttcaacgagatggtgctcctgcagatggaggacaaggcctggctggtccaccggcagtggttcctcgacctgcccctgccctggctcccgggcgccgacacgcaggggagcaactggatccagaaggagaccctggtgaccttcaagaacccccacgccaagaagcaggacgtggtcgtgctgggctcccaggagggggcgatgcacaccgccctcacgggcgccaccgagatccagatgagcagcgggaacctgctgttcaccggccacctcaagtgccgcctgcggatggacaagctgcagctcaagggcatgtcctacagcatgtgcaccgggaagttcaaggtcgtgaaggagatcgccgagacgcagcacggcaccatcgtgatccgcgtccagtacgagggggacggctccccctgcaagatccccttcgagatcatggacctggagaagcggcacgtgctgggccgcctcatcaccgtgaacccgatcgtcaccgagaaggacagccccgtgaacatcgaggccgagccgcccttcggggactcctacatcatcatcggcgtggagccggggcagctgaagctgaactggttcaagaagggcagctccatcgggcagatgctcgagacgaccatgcgcggcgcgaagcggatggccatcctgggcgacaccgcctgggacttcgggagcctgggcggggtcttcacctccatcggcaaggccctccaccaggtgttcggggccatctacggcgcggccttcagcggcgtgtcctggacgatgaagatcctgaccggggtcatcatcacctggatcggcatgaacagccgctccaccagcctgtccgtgagcctggtgctcgtcgggatcgtgacgctgtacctgggcgtgatggtccaggccgactccgggtgcgtggtgagctggaagaacaaggagctcaagtgcggctccggcatcttcgtcaccgacaacgtgcacacctggaccgagcagtacaagttccagcccgagagccccagcaagctggcctccgcgatccagaaggcccacgaggaggggatctgcggcatccggagcgtgacgcgcctggagaacctcatgtggaagcagatcacccccgagctgaaccacatcctgtccgagaacgaggtcaagctcaccatcatgaccggggacatcaagggcatcatgcaggtcgggaagcggagcctgcgcccgcagcccacggagctgcggtactcctggaagacctggggcaaggccaagatgctcagcaccgagctgcacaaccagaccttcctgatcgacggccccgagacggccgagtgcccgaacaccaaccgcgcctggaactccctcgaggtggaggactacgggttcggcgtcttcaccaccaacatctggctgcggctgcgcgagaagcaggacgtgttctgcgacagcaagctcatgtccgcggccatcaaggacaaccgggccgtgcacgccgacatggggtactggatcgagagcgccctgaacgacacctggaagatcgagaaggcgtccttcatcgaggtcaagagctgccactggcccaagtcccacacgctgtggagcgacggcgtgctcgagtccgagatggtgatccccaagaacttcgccggccccgtcagccagcacaacaaccgcccggggtaccacacccagaccgccggcccctggcacctggggaagctggagatggacttcgacttctgcgagggcaccacggtggtggtcaccgaggactgcgggaaccggggcccctccctccgcaccaccacggccagcggcaagctgatcaccgagtggtgctgccggagctgcaccctgcccccgctccgctaccgcggggaggacggctgctggtacgggatggagatccgccccctgaaggagaaggaggagaacctggtgtccagcctcgtgaccgccggccacgggcagatcgacaacttctccctgggcatcctgggcatggccctgttcctggaggagatgctgcggacgcgcgtcgggaccaagcacgccatcctcctggtggccgtgagcttcgtcaccctgatcaccggcaacatgtccttccgcgacctcgggcgggtgatggtgatggtcggcgccacgatgaccgacgacatcgggatgggcgtgacctacctggcgctgctcgccgccttcaaggtgcgccccaccttcgccgccggcctgctgctccggaagctgacgagcaaggagctgatgatgaccaccatcgggatcgtcctcctgtcccagagctccatccccgagaccatcctggagctcacggacgcgctggccctgggcatgatggtgctcaagatggtgcgcaacatggagaagtaccagctggccgtcaccatcatggccatcctgtgcgtgccgaacgccgtcatcctccagaacgcgtggaaggtgagctgcaccatcctggccctggtgtccgtcagccccctcttcctgacctccagccagcagaaggccgactggatccccctggccctcacgatcaaggggctgaaccccaccgccatcttcctgaccaccctctcccggacgagcaagaagcgctcctggccgctgaacgaggcgatcatggccgtgggcatggtgagcatcctggcctccagcctcctgaagaacgacatccccatgaccggccccctggtcgccgggggcctcctgaccgtgtgctacgtgctgaccgggcggagcgcggacctcgagctggagcgcgccgccgacgtcaagtgggacgaccaggccgagatctccggcagctcccccatcctgagcatcacgatctccgaggacgggagcatgtccatcaagaacgaggaggaggagcagaccctcaccatcctgatccggaccggcctgctcgtgatcagcggcctgttcccggtgtccatccccatcaccgccgcggcctggtacctgtgggaggtcaagaagcagcgcgccggggtgctctgggacgtgccctccccgccgcccgtcggcaaggccgagctggaggacggggcctaccggatcaagcagaagggcatcctggggtactcccagatcggcgcgggcgtgtacaaggaggggacgttccacaccatgtggcacgtgacccgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgccctggagcccggcaagaacccccgcgccgtgcagaccaagcccgggctgttcaagacgaacaccggcaccatcggggcggtgagcctcgacttctcccccggcaccagcggctcccccatcgtcgacaagaaggggaaggtggtgggcctgtacgggaacggcgtcgtgacgcggagcggcgcctacgtgtccgccatcgcccagaccgagaagtccatcgaggacaaccccgagatcgaggacgacatcttccgcaagcggcgcctgaccatcatggacctgcaccccggggccggcaagaccaagcggtacctccccgcgatcgtccgcgaggccatcaagcgggggctgcgcacgctgatcctcgccccgacccgcgtggtggccgcggagatggaggaggccctgcggggcctgcccatccgctaccagacccccgccatccgggccgagcacaccgggcgcgagatcgtcgacctcatgtgccacgccacgttcaccatgcggctgctgagccccatccgcgtgccgaactacaacctcatcatcatggacgaggcgcacttcaccgaccccgcctccatcgccgcccggggctacatcagcacccgcgtggagatgggcgaggccgcggggatcttcatgacggccacgccgcccggctcccgggacccgttcccccagagcaacgcccccatcatggacgaggagcgcgagatccccgagcggtcctggaacagcgggcacgagtgggtcaccgacttcaagggcaagaccgtgtggttcgtgccgtccatcaagacggggaacgacatcgccgcctgcctgcgcaagaacggcaagcgggtcatccagctgagccgcaagaccttcgactccgagtacgtgaagacccggaccaacgactgggacttcgtggtcacgaccgacatcagcgagatgggcgcgaacttcaaggccgagcgcgtgatcgacccccggcgctgcatgaagcccgtgatcctcaccgacggggaggagcgggtcatcctggccggccccatgccggtgacccactccagcgccgcgcagcgccgcgggcggatcggccgcaaccccaagaacgagaacgaccagtacatctacatgggggagcccctggagaacgacgaggactgcgcccactggaaggaggccaagatgctcctggacaacatcaacacgcccgagggcatcatcccgtccatgttcgagcccgagcgggagaaggtggacgccatcgacggcgagtaccgcctgcgcggggaggcccgcaagaccttcgtcgacctcatgcggcgcggcgacctgcccgtgtggctggcgtacaaggtggccgccgaggggatcaactacgccgaccggcgctggtgcttcgacggcacccggaacaaccagatcctcgaggagaacgtcgaggtggagatctggaccaaggagggggagcgcaagaagctgaagccgcggtggctggacgcccgcatctacagcgaccccctcgcgctgaaggagttcaaggagttcgccgccggccggaagtccctgacgctcaacctgatcaccgagatgggccgcctgcccaccttcatgacccagaaggcccgggacgccctcgacaacctggcggtcctgcacacggccgaggccgggggcaaggcctacaaccacgcgctcagcgagctgcccgagaccctggagaccctcctgctgctcaccctgctggccaccgtgaccgggggcatcttcctcttcctgatgtccggccgcgggatcggcaagatgaccctggggatgtgctgcatcatcaccgccagcatcctcctgtggtgcgcccagatccagccgcactggatcgccgcgtccatcatcctggagttcttcctcatcgtgctgctgatccccgagcccgagaagcagcggacgccccaggacaaccagctcacgtacgtcatcatcgccatcctgaccgtggtggccgccaccatggccaacgagatgggcttcctggagaagaccaagaaggacctcgggctgggcaacatcgtcacgcagcagccggagagcaacatcctggacatcgacctccgccccgcgagcgcctggaccctgtacgccgtggccaccaccttcatcacgcccatgctgcggcactccatcgagaacagctccgtgaacatgagcctcaccgccatcgcgaaccaggccaccgtcctgatgggcctggggaagggctggcccctctccaagatggacatcggggtgccgctgctggccatcggctgctgcagccaggtgaaccccatcaccctcacggccgccctgttcctgctcgtcgcgcactacgccatcatcgggcccggcctgcaggccaaggccacccgcgaggcgcagaagcgcgccgccgccggcatcatgaagaaccccaccgtggacgggatcaccgtgatcgacctggacccgatcccctacgaccccaagttcgagaagcagctcggccaggtcatgctgctggtgctctgcgtgacgcaggtcctgatcatgcggaccacctgggccctgtgcgaggcgctcaccctggccacggggcccgtgtccaccctgtgggagggcaacccggggcgcttctggaacaccaccatcgccgtgagcatggccaacatcttccggggctcctacctcgccggcgcggggctgctgttctgcatcatgaacaacacgacccgcctccggcgcggcaccgggcacctccggaagaccctgggcgacaagtgcaagagccgcctcaacacgctgggcaagtccgagttccagatctacaagaagtccgggatccaggaggtcgaccggaccctggccaaggagggcatcaagcgcggggagaccgaccaccacgccgtgtcccggggcagcgccaagctccgctggttcgtggagcggaacctggtcacccccgaggggaaggtggtggacctgggctgcggccgcgggggctggtcctactactgcgggggcctcaagaacgtccgggaggtgaaggggctgacgaagggcggccccgggcacgaggagcccatcccgatgagcacctacggctggaacctggtgcgcctccagtccggggtcgacgtgttcttcatcccgcccgagaagtgcgacaccctgctgtgcgacatcggcgagagctcccccaacccgaccgtggaggccgggcggaccctccgcgtcctgaacctggtggagaactggctgaacaacaacacgcagttctgcatcaaggtgctcaacccctacatgcccagcgtcatcgagaagatggagaccctgcagcggaagtacggcggcgcgctggtgcgcaacccgctcagccgcaactccacccacgagatgtactgggtgagcaacgcctccgggaacatcgtcagctccgtgaacatgatcagccggatgctgatcaaccgcttcaccatgcggcacaagaaggccacgtacgagcccgacgtggacctgggctccgggacccgcaacatcggcatcgagagcgagacccccaacctcgacatcatcgggaagcggatcgagaagatcaagcaggagcacgagacctcctggcactacgaccaggaccacccctacaagacgtgggcctaccacggcagctacgagaccaagcagaccggctccgcgagctccatggtcaacggggtggtgcgcctgctgaccaagccgtgggacgtcgtgcccatggtgacgcagatggccatgaccgacaccacccccttcggccagcagcgggtcttcaaggagaaggtggacacgcgcacccaggagcccaaggaggggaccaagaagctcatgaagatcaccgccgagtggctgtggaaggagctgggcaagaagaagacgccgcggatgtgcacccgcgaggagttcaccaagaaggtgcggagcaacgccgccctcggcgcgatcttcaccgacgagaacaagtggaagtccgcccgcgaggccgtcgaggacgggcggttctgggagctggtggacaaggagcgcaacctgcacctcgagggcaagtgcgagacgtgcgtctacaacatgatggggaagcgggagaagaagctgggcgagttcgggaaggccaagggcagccgcgccatctggtacatgtggctgggcgcgcggttcctcgagttcgaggccctggggttcctgaacgaggaccactggttctcccgcgagaacagcctctccggcgtggagggggagggcctgcacaagctggggtacatcctccgggaggtgagcaagaaggagggcggcgccatgtacgccgacgacaccgccgggtgggacacccgcatcaccatcgaggacctgaagaacgaggagatgatcacgaaccacatggcgggcgagcacaagaagctggccgaggccatcttcaagctcacctaccagaacaaggtcgtgcgggtgcagcgccccacgccccgggggaccgtcatggacatcatcagccggcgcgaccagcggggctccggccaggtggggacgtacggcctgaacaccttcaccaacatggaggcccagctgatccgccagatggagggggagggcatcttcaagagcatccagcacctcaccgcgacggaggagatcgccgtgcaggactggctggcccgggtcgggcgcgagcggctgtcccgcatggccatcagcggcgacgactgcgtggtgaagcccctcgacgaccggttcgcccgcgcgctgaccgccctgaacgacatgggcaaggtccggaaggacatccagcagtgggagccgtcccgcgggtggaacgactggacccaggtgcccttctgcagccaccacttccacgagctcatcatgaaggacggccggaccctggtggtcccctgccgcaaccaggacgagctgatcgggcgggcccgcatctcccagggcgccgggtggagcctccgggagaccgcctgcctgggcaagtcctacgcgcagatgtggagcctgatgtacttccaccgccgggacctccgcctggccgccaacgccatctgctccgccgtgcccagccactgggtgccgacgtcccgcaccacctggagcatccacgcgtcccacgagtggatgaccacggaggacatgctgaccgtctggaaccgggtgtggatccaggagaacccctggatggaggacaagacccccgtggagagctgggaggagatcccctacctcggcaagcgcgaggaccagtggtgcgggtccctgatcggcctgaccagccgggccacgtgggccaagaacatccagaccgccatcaaccaggtccgcagcctcatcgggaacgaggagtacaccgactacatgccgtccatgaagcggttccgccgggaggaggaggaggccggcgtgctgtggtga

SEQ ID NO: 9697 - RNA, 9876 nt, synthetic construct
  misc_feature 1..9876: note = derived and/or modified CDS sequence (opt1) from DENV-2__KU517845__SS-prME
  source 1..9876: mol_type = other RNA
accgccgggatcatcatcatgatgatccccaccgtgatcgccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcgcctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcgcagcggatcgagacctgggtcctccgccaccccgggttcaccatcatggccgccatcctggcctacaccatcggcaccacctacttccagcgggtgctgatcttcatcctcctgaccgcggtgaccccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatggccggggacatcaagggcatcatgcaggcggggaagcggagcctccgcccgcagcccacggagctgaagtactcctggaaggcctggggcaaggccaagatgctgagcaccgagctccacaaccacaccttcctgatcgacggccccgagaccgccgagtgcccgaacacgaaccgggcctggaactccctggaggtggaggactacgggttcggcgtgttcaccaccaacatctggctcaagctgaaggagcgccaggacgcgttctgcgacagcaagctgatgtccgccgccatcaaggacaaccgggccatccacgccgacatggggtactggatcgagagcgcgctcaacgacacctggaagatcgagaaggcctccttcatcgaggtcaagagctgccactggcccaagtcccacacgctgtggagcaacggcgtgctggagtccgagatgatcatccccaagaacttcgccggccccgtgagccagcacaactaccgcccggggtaccacacccagaccgccggcccctggcacctcgggcggctggagatggacttcgacttctgcgagggcaccaccgtcgtggtgacggaggactgcgggaaccgcggccccagcctgcggaccaccaccgcgtccggcaagctcatcacggagtggtgctgccgcagctgcaccctgcccccgctgcggtaccgcggggaggacggctgctggtacgggatggagatccggcccctcaaggagaaggaggagaacctggtcaactccctggtgaccgccggccacgggcagatcgacaacttcagcctcggcgtgctgggcatggccctgttcctcgaggagatgctgcgcacccgggtcgggacgaagcacgccatcctgctcgtggccgtgtccttcgtcaccctgatcaccggcaacatgagcttccgcgacctggggcgcgtgatggtgatggtcggcgcgaccatgacggacgacatcgggatgggcgtgacctacctcgccctgctggccgccttcaaggtgcggcccaccttcgccgcgggcctcctgctgcgcaagctcacctccaaggagctgatgatgacgaccatcgggatcgtcctgctcagccagtccaccatccccgagaccatcctggagctgacggacgccctcgccctgggcatgatggtgctgaagatcgtgcggaacatggagaagtaccagctcgccgtcaccatcatggccatcctgtgcgtgccgaacgcggtcatcctgcagaacgcctggaaggtgagctgcaccaccctcgccgtggtctccgtgagccccctgctgctcacgtccagccagcagaaggccgactggatccccctggtgctgaccatcaaggggctcaaccccaccgcgatcttcctgaccacgctgtcccgcaccagcaagaagcggtcctggccgctcaacgaggccatcatggccgtcggcatggtgagcatcctggcctccagcctgctcaagaacgacatccccatgaccggccccctggtggccgggggcctgctcaccgtctgctacgtgctgacggggcgcagcgcggacctggagctcgagcgggccgccgacgtgcgctgggaggagcaggccgagatctccggcagctcccccatcctgagcatcaccgtctccgaggacgggagcatgtccatcaagaacgaggaggaggagcagaccctgaccatcctcatccggacgggcctgctggtgatcagcggcctcttcccggtgtccatccccatcaccgccgcggcctggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgcgggcgtgtacaaggaggggaccttccacaccatgtggcacgtgacccgcggcgccgtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagacgaagcccgggctgttcaagaccaacaccggcaccatcggggcggtgagcctggacttctcccccggcacgagcggctcccccatcgtcgacaagaaggggaaggtggtgggcctctacgggaacggcgtcgtgacccggagcggcacctacgtgtccgccatcgcccagaccgagaagtccatcgaggacaaccccgagatcgaggacgacatcttccgcaagaagcggctgacgatcatggacctgcaccccggggccggcaagaccaagcgctacctgcccgcgatcgtccgggaggccatcaagcgcgggctccggaccctgatcctggccccgacccgcgtggtggccgccgagatggaggaggcgctccgcggcctgcccatccggtaccagacgcccgccatccgcgccgagcacaccgggcgggagatcgtcgacctgatgtgccacgccaccttcaccatgcgcctcctgagccccatccgggtgccgaactacaacctgatcatcatggacgaggcccacttcacggaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtcacggacttcaagggcaagaccgtgtggttcgtgccgtccatcaaggccgggaacgacatcgccgcgtgcctccggaagaacggcaagaaggtcatccagctgagccgcaagaccttcgactccgagtacatcaagacccggacgaacgactgggacttcgtggtgaccaccgacatcagcgagatgggcgccaacttcaaggccgagcgcgtcatcgacccccggcgctgcatgaagcccgtgatcctgaccgacggggaggagcgggtgatcctcgccggccccatgccggtcacgcactccagcgccgcgcagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtcgacctgatgcggcgcggcgacctccccgtgtggctggcgtaccgggtcgccgccgaggggatcaactacgccgaccgccggtggtgcttcgacggcgtgaagaacaaccagatcctggaggagaacgtggaggtcgagatctggaccaaggagggggagcgcaagaagctcaagccgcggtggctggacgcccgcatctacagcgaccccctggcgctcaaggagttcaaggagttcgccgccggccggaagtccctgacgctgaacctcatcaccgagatgggccgcctgcccaccttcatgacccagaaggcccggaacgcgctggacaacctcgccgtgctgcacacggccgaggccgggggccgcgcctacaaccacgcgctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtcctcctgatccccgagcccgagaagcagcggacgccccaggacaaccagctgacgtacgtggtgatcgccatcctcaccgtcgtggccgccaccatggccaacgagatgggcttcctggagaagaccaagaaggacttcgggctgggcagcatcgcgaaccagcagccggagagcaacatcctcgacatcgacctgcgccccgcctccgcctggacgctgtacgccgtggccaccaccttcatcacccccatgctccggcacagcatcgagaactccagcgtcaacgtgtccctgacggcgatcgccaaccaggccaccgtgctgatgggcctcgggaagggctggcccctgagcaagatggacatcggggtcccgctgctcgccatcggctgctactcccaggtgaaccccatcaccctgaccgcggccctgctcctgctggtggcccactacgccatcatcgggcccggcctccaggccaaggcgacgcgcgaggcccagaagcgggccgccgccggcatcatgaagaaccccaccgtcgacgggatcaccgtgatcgacctggacccgatcccctacgaccccaagttcgagaagcagctgggccaggtgatgctcctggtcctgtgcgtgacccaggtgctcatgatgcgcacgacctgggcgctgtgcgaggccctgaccctcgccaccgggcccatcagcacgctgtgggagggcaacccggggcgcttctggaacaccaccatcgccgtctccatggccaacatcttccggggcagctacctggcgggcgccgggctcctgttctccatcatgaagaacaccgccaacacgcgccggggcaccgggaacaccggcgagaccctgggcgagaagtggaagaaccgcctcaacgccctgggcaagagcgagttccagatctacaagaagtccggcatccaggaggtggaccggacgctggcgaaggaggggatcaagcgcggcgagaccgaccaccacgccgtgagccgggggtccgccaagctccgctggttcgtcgagcggaacctggtgacccccgagggcaaggtggtcgacctgggctgcgggcgcggcgggtggagctactactgcggcgggctcaagaacgtgaaggaggtgaagggcctgaccaagggcgggcccggccacgaggagcccatcccgatgtccacgtacgggtggaacctggtccggctccagagcggcgtggacgtgttcttcacgccgcccgagaagtgcgacaccctgctgtgcgacatcggggagtccagccccaacccgaccgtcgaggccggccgcacgctccgggtgctgaacctggtggagaactggctcaacaacaacacccagttctgcatcaaggtcctgaacccctacatgcccagcgtgatcgagaagatggaggccctgcagcgcaagtacggcggggcgctggtgcggaacccgctctcccgcaacagcacccacgagatgtactgggtctccaacgccagcggcaacatcgtgtccagcgtgaacatgatctcccggatgctgatcaaccgcttcaccatgcggcacaagaaggccacctacgagcccgacgtcgacctggggagcggcacgcgcaacatcgggatcgagtccgagacccccaacctcgacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtggtccggctgctgaccaagccgtgggacgtgatccccatggtgacccagatggcgatgacggacaccacccccttcgggcagcagcgcgtcttcaaggagaaggtggacacccggacgcaggagcccaaggagggcaccaagaagatcatgaagatcaccgccgagtggctctggaaggagctgggcaagaagaagaccccgcgcatgtgcacgcgggaggagttcacccgcaaggtccggtccaacgccgccctgggggccatcttcaccgacgagaacaagtggaagtccgcgcgcgaggccgtggaggactccggcttctgggagctcgtggacaaggagcggaacctgcacctggaggggaagtgcgagacctgcgtctacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgagcggggtggagggcgaggggctccacaagctgggctacatcctgcgcgacgtgtccaagaaggagggcggggccatgtacgccgacgacacggccggctgggacacccggatcaccctcgaggacctgaagaacgaggagatggtcaccagccacatgaagggggagcaccgcaagctggcggaggccatcttcaagctcacgtaccagaacaaggtggtgcgggtccagcgccccacgccccggggcaccgtgatggacatcatctcccgccgggaccagcgcgggagcggccaggtggtcacctacggcctgaacacgttcaccaacatggaggcccagctgatccgccagatggagggggagggcgtgttcaagtccatccagcagctcaccgtgaccgaggagatcgccgtcaagaactggctggtgcgggtggggcgcgagcggctgagccgcatggccatctccggcgacgactgcgtcgtgaagcccctcgacgaccggttcgcgagcgccctgacggccctgaacgacatgggcaaggtgcgcaaggacatccagcagtgggagccgtcccgggggtggaacgactggacccaggtccccttctgcagccaccacttccacgagctcatcatgaaggacggccgcgtgctggtggtcccctgccggaaccaggacgagctgatcgggcgcgcccggatctcccagggcgccgggtggagcctccgcgagaccgcgtgcctgggcaagtcctacgcccagatgtggagcctgatgtacttccaccggcgcgacctccggctggccgccaacgccatctgctccgcggtgcccagccactgggtgccgacctcccgcacgacctggagcatccacgccacccacgagtggatgaccaccgaggacatgctgacggtctggaaccgggtgtggatccaggagaacccctggatggaggacaagacccccgtggagagctgggaggagatcccctacctcggcaagcgcgaggaccagtggtgcgggtccctgatcggcctgaccagccgggccacctgggccaagaacatccagacggcgatcaaccaggtccgctccctcatcgggaacgaggagtacaccgactacatgccgagcatgaagcgcttccggcgcgaggaggaggaggccggcgtgctgtggtga

SEQ ID NO: 9698 - RNA, 9876 nt, synthetic construct
  misc_feature 1..9876: note = derived and/or modified CDS sequence (opt1) from DENV-2__KU517847__SS-prME
  source 1..9876: mol_type = other RNA
accgccgggatcatcatcatgatgatccccaccgtgatggccttccacctgaccacccgcaacggggagccccacatgatcgtgagccggcaggagaagggcaagagcctcctgttcaagaccgagaacggggtgaacatgtgcaccctgatggcgatggacctcggggagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgaccgccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgaccgagaacgaggtcaagctgacgatcatgaccggggacatcaagggcatcatgcaggccgggaagcggtccctccgcccgcagcccaccgagctgaagtacagctggaaggcgtggggcaaggccaaggtgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgtcctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtcgtggtgaccgagaactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacgggcagatcgacaacttcagcctcggcgtgctgggcatggcgctgttcctcgaggagatgctgcgcacccgggtcgggaccaagcacgccatcctgctcgtggccgtgtccttcgtcaccctgatcacgggcaacatgagcttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcacctccaaggagctgatgatgaccaccatcgggatcgtcctgctcagccagtccacgatccccgagaccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcacggcgctcgccgtggtctccgtgagccccctgctgctcacctccagccagcagaagaccgactggatccccctggccctgaccatcaaggggctcaaccccacggccatcttcctgaccaccctgtcccgcaccagcaagaagcggtcctggccgctcaacgaggcgatcatggccgtgggcatggtcagcatcctggcctccagcttcctgaagaacgacatccccatgacgggccccctcgtggccgggggcctgctgaccgtgtgctacgtcctcaccgggcgcagcgccgacctggagctggagcgggcggccgacatccgctgggaggagcaggccgagatctccggcagctcccccatcctcagcatcaccatctccgaggacgggagcatgtccatcaagaacgaggaggaggagcagacgctgaccatcctgatccggaccggcctcctggtgatcagcggcctgttcccggcctccatccccatcaccgccgcggcctggtacctctgggaggtgaagaagcagcgcgccggggtcctgtgggacgtgcccagcccgccgcccgtgggccgggccgagctggaggacggggcctaccgcatcaagcagaagggcatcctcgggtactcccagatcggcgcgggcgtctacaaggaggggaccttccacacgatgtggcacgtgacccggggcgccgtgctgatgcacaaggggaagcgcatcgagcccagctgggccgacgtcaagaaggacctgatctcctacggcgggggctggaagctcgagggcgagtggaaggagggggaggaggtccaggtgctggccctggagcccggcaagaacccccgggccgtccagaccaagcccggcctgttcaagaccaacacgggcaccatcggggcggtgagcctggacttctcccccggcaccagcggctcccccatcgtggacaagaaggggaaggtcgtgggcctgtacgggaacggcgtggtcacccgcagcggcacgtacgtgtccgccatcgcccagaccgagaagtccatcgaggacaaccccgagatcgaggacgacatcttccggaagaagcgcctcaccatcatggacctgcaccccggggccggcaagaccaagcggtacctgcccgcgatcgtgcgcgaggccatcaagcgggggctgcgcacgctcatcctggccccgacccgcgtcgtggccgccgagatggaggaggcgctgcggggcctccccatccgctaccagacccccgccatccgggccgagcacaccgggcgcgagatcgtggacctgatgtgccacgccacgttcaccatgcggctgctcagccccatccgcgtcccgaactacaacctgatcatcatggacgaggcccacttcaccgaccccgcgtccatcgccgcccggggctacatcagcacccgcgtggagatgggcgaggccgccgggatcttcatgacggcgacgccgcccggctcccgggacccgttcccccagagcaacgcccccatcatggacgaggagcgcgagatccccgagcggtcctggaacagcgggcacgagtgggtgaccgacttcaagggcaagaccgtctggttcgtgccgtccatcaaggccgggaacgacatcgccgcgtgcctgcgcaagaacggcaagaaggtgatccagctcagccggaagacgttcgactccgagtacatcaagacccgcaccaacgactgggacttcgtcgtgaccacggacatcagcgagatgggcgccaacttcaaggccgagcgggtgatcgacccccgccggtgcatgaagcccgtcatcctgaccgacggggaggagcgcgtgatcctggccggccccatgccggtgacccactccagcgccgcgcagcggcgcgggcgcgtcggccggaaccccaagaacgagaacgaccagtacatctacatgggggagcccctcgagaacgacgaggactgcgcccactggaaggaggccaagatgctgctggacaacatcaacacccccgagggcatcatcccgtccatgttcgagcccgagcgcgagaaggtggacgccatcgacggcgagtaccggctccgcggggaggcccggaagacgttcgtggacctgatgcgccggggcgacctgcccgtctggctcgcgtaccgcgtggccgccgaggggatcaactacgccgaccggcgctggtgcttcgacggcgtcaagaacaaccagatcctggaggagaacgtggaggtggagatctggaccaaggagggggagcggaagaagctgaagccgcgctggctcgacgcccggatctacagcgaccccctggcgctgaaggagttcaaggagttcgccgccggccgcaagtccctcaccctgaacctgatcaccgagatgggccggctccccacgttcatgacccagaaggcccgcaacgcgctggacaacctggccgtcctccacaccgccgaggccgggggccgggcctacaaccacgcgctgagcgagctgcccgagaccctcgagacgctgctgctcctgaccctgctcgccaccgtgaccgggggcatcttcctgttcctgatgtccggcaaggggatcggcaagatgaccctcgggatgtgctgcatcgtgacggccagcatcctgctgtggtacgcccagatccagccgcactggatcgccgcgtccatcatcctcgagttcttcctgatcgtcctgctcatccccgagcccgagaagcagcgcacgccccaggacaaccagctgacctacgtggtgatcgccatcctgaccgtcgtggccgccacgatggccaacgagatgggcttcctcgagaagaccaagaaggacttcgggctgggcagcatcaccacccagcagccggagagcaacatcctggacatcgacctccggcccgcgtccgcctggacgctgtacgccgtggccaccaccttcatcacccccatgctgcgccacagcatcgagaactccagcgtcaacgtgtccctcacggccatcgcgaaccaggccaccgtgctgatgggcctggggaagggctggcccctcagcaagatggacatcggggtcccgctgctggccatcggctgctactcccaggtgaaccccatcaccctcaccgccgcgctgctgctcctggtggcccactacgccatcatcgggcccggcctgcaggccaaggccacgcgggaggcgcagaagcgcgccgccgccggcatcatgaagaaccccaccgtcgacgggatcaccgtgatcgacctcgacccgatcccctacgaccccaagttcgagaagcagctgggccaggtgatgctgctcgtcctgtgcgtgacccaggtgctgatgatgcgcacgacctgggccctctgcgaggcgctgaccctggccaccgggcccatcagcacgctctgggagggcaacccggggcggttctggaacaccaccatcgccgtctccatggccaacatcttccgcggcagctacctggccggcgcggggctcctcttctccatcatgaagaacaccgccaacacgcggcgcggcaccgggaacaccggcgagaccctgggcgagaagtggaagaaccggctgaacgccctcggcaagagcgagttccagatctacaagaagtccggcatccaggaggtggaccgcacgctggccaaggaggggatcaagcggggcgagaccgaccaccacgcggtgagccgcgggtccgccaagctgcggtggttcgtcgagcgcaacctcgtgacccccgagggcaaggtggtcgacctgggctgcgggcggggcgggtggagctactactgcggcgggctgaagaacgtgaaggaggtgaagggcctcaccaagggcgggcccggccacgaggagcccatcccgatgtccacgtacgggtggaacctggtccgcctgcagagcggcgtggacgtgttcttcacgccgcccgagaagtgcgacaccctcctgtgcgacatcggggagtccagccccaacccgaccgtcgaggccggccggaccctgcgcgtgctcaacctggtggagaactggctgaacaacaacacgcagttctgcatcaaggtcctcaacccctacatgcccagcgtgatcgagaagatggaggccctgcagcggcgctacggcggggccctggtgcggaacccgccctcccgcaacagcacccacgagatgtactgggtctccaacgcgagcggcaacatcgtgtccagcgtgaacatgatctcccggatgctgatcaaccgcttcaccatgcgccacaagaaggccacctacgagcccgacgtcgacctcgggagcggcacgcggaacatcgggatcgagtccgaggtgcccaacctggacatcatcggcaagcgcatcgagaagatcaagcaggagcacgagaccagctggcactacgaccaggaccacccgtacaagacctgggcctaccacggctcctacgagaccaagcagacggggagcgcctccagcatggtgaacggcgtcgtgcggctgctcaccaagccctgggacgtgatccccatggtcacccagatggccatgaccgacacgacccccttcgggcagcagcgcgtgttcaaggagaaggtcgacacccggacccaggagccgaaggagggcacgaagaagctgatgaagatcaccgcggagtggctgtggaaggagctcggcaagaagaagacgccccgcatgtgcacccgggaggagttcacgcgcaaggtgcggtccaacgccgccctgggggccatcttcaccgacgagaacaagtggaagtccgcccgcgaggcggtggaggactccggcttctgggagctggtcgacaaggagcggaacctccacctggaggggaagtgcgagacctgcgtgtacaacatgatgggcaagcgcgagaagaagctgggggagttcggcaaggccaagggcagccgggccatctggtacatgtggctcggggcccgcttcctggagttcgaggcgctgggcttcctcaacgaggaccactggttctcccgggagaacagcctgagcggggtggagggcgaggggctgcacaagctcggctacatcctgcgcgacgtctccaagaaggagggcggggccatgtacgccgacgacaccgccggctgggacacgcggatcaccctggaggacctcaagaacgaggagatggtgaccaaccacatggagggggagcacaagaagctggccgaggcgatcttccgcctgacctaccagaacaaggtggtccgggtgcagcgccccacgccccggggcaccgtgatggacatcatcagccgccgcgaccagcgggggtccggccaggtcgtgacctacggcctcaacaccttcacgaacatggaggcccagctgatccgccagatggagggggagggcgtgttcaagagcatccagcacctgaccgccaccgaggagatcgccgtcaagaactggctcgtgcgggtggggcgcgagcggctgtcccgcatggccatcagcggcgacgactgcgtcgtgaagccgttcgacgaccggttcgcgaacgccctgaccgccctcaacgacatgggcaaggtgcgcaaggacatccagcagtgggagccctcccgggggtggaacgactggacgcaggtccccttctgcagccaccacttccacgagctgatcatgaaggacggccgcgtgctggtggtcccctgccggaaccaggacgagctcatcgggcgcgcccggatctcccagggcgccgggtggagcctgcgcgagaccgcgtgcctgggcaagtcctacgcccagatgtggagcctcatgtacttccaccggcgcgacctgcggctggccgccaacgccatctgctccgcggtgccgagccactgggtgcccacctcccgcaccacctggagcatccacgccacgcacgagtggatgaccaccgaggacatgctcaccgtctggaaccgggtgtggatccaggagaacccctggatggaggacaagacgcccgtggagtcctgggaggagatcccgtacctgggcaagcgcgaggaccagtggtgcgggagcctgatcggcctcaccagccgcgccacctgggccaagaacatccagaccgcgatcaaccaggtccggtccctgatcgggaacgaggagtacacggactacatgcccagcatgaagcgcttccggcgcgaggaggaggaggccggcgtgctgtggtga

SEQ ID NO: 9699 - RNA, 9876 nt, synthetic construct
  misc_feature 1..9876: note = derived and/or modified CDS sequence (opt1) from DENV-2__JQ955623__SS-prME
  source 1..9876: mol_type = other RNA
accgccgggatgatcatcatgctgatccccaccgccatggcgttccacctcaccacccggaacggggagccccacatgatcgtgagccggcaggagaagggcaagagcctgctgttcaagaccgaggacggggtcaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccggcgggagaagcggagcgtggccctggtcccccacgtgggcatggggctcgagacccgcaccgagacctggatgtccagcgagggcgcctggaagcacgcgcagcggatcgagacctggatcctgcgccaccccgggttcacgatcatggccgccatcctggcctacaccatcggcaccacccacttccagcgggtgctcatcttcatcctgctgacggcggtcgccccctccatgaccatgcgctgcatcgggatcagcaaccgggacttcgtggagggcgtgtccggcgggagctgggtcgacatcgtgctcgagcacggctcctgcgtgaccaccatggccaagaacaagcccacgctggacttcgagctgatcaagaccgaggccaagcagcccgccaccctccgcaagtactgcatcgaggcgaagctgaccaacacgaccaccgccagccggtgcccgacccagggggagccctccctgaacgaggagcaggacaagcgcttcgtctgcaagcacagcatggtggaccggggctggggcaacgggtgcggcctcttcgggaagggcgggatcgtgacgtgcgccatgttcacgtgcaagaagaacatggagggcaagatcgtccagcccgagaacctggagtacaccatcgtggtgacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccgcaccggcctcgacttcaacgagatggtcctgctgcagatggagaacaaggcgtggctcgtgcaccggcagtggttcctggacctgcccctcccctggctgccgggcgccgacacccaggggtccaactggatccagaaggagaccctggtgacgttcaagaacccccacgccaagaagcaggacgtcgtggtcctcggcagccaggagggggccatgcacaccgccctgaccggcgcgaccgagatccagatgagctccgggaacctcctgttcacgggccacctgaagtgccgcctgcggatggacaagctccagctgaagggcatgagctactccatgtgcaccgggaagttcaaggtggtgaaggagatcgccgagacccagcacggcaccatcgtcatccgcgtgcagtacgagggggacggcagcccctgcaagatccccttcgagatcatggacctggagaagcggcacgtgctcggccgcctgatcacggtcaacccgatcgtgaccgagaaggactcccccgtgaacatcgaggccgagccgcccttcggggacagctacatcatcgtcggcgtggagccggggcagctgaagctctcctggttcaagaagggcagctccatcgggcagatgttcgagaccaccatgcgcggcgccaagcggatggccatcctgggcgacacggcgtgggacttcgggagcctgggcggggtgttcacctccatcggcaaggccctccaccaggtcttcggggccatctacggcgccgcgttcagcggcgtgtcctggaccatgaagatcctgatcggggtggtcatcacctggatcggcatgaacagccgctccacgagcctgtccgtgagcctggtgctcgtcgggatcgtgaccctgtacctgggcgtgatggtccaggccgactccgggtgcgtggtgagctggaagaacaaggagctcaagtgcggcagcggcatcttcatcaccgacaacgtccacacctggacggagcagtacaagttccagcccgagtcccccagcaagctggcctccgccatccagaaggcccacgaggaggggatctgcggcatccggagcgtgacccgcctggagaacctcatgtggaagcagatcacccccgagctgaaccacatcctgtccgagaacgaggtgaagctcaccatcatgacgggggacatcaagggcatcatgcaggcggggaagcggagcctgcgcccgcagcccaccgagctgaagtactcctggaagacctggggcaaggccaagatgctcagcaccgagccccacaaccagacgttcctgatcgacggcccggagaccgccgagtgccccaacaccaaccgggcctggaactccctggaggtcgaggactacgggttcggcgtgttcaccacgaacatctggctcaagctgaaggagcgccaggacgtgttctgcgacagcaagctgatgtccgccgcgatcaaggacaaccgggccgtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggcccggtgagccagcacaactaccgccccgggtaccacacccagaccgccggcccctggcacctcgggaagctggagatggacttcgacttctgcgagggcacgaccgtggtggtcaccgaggactgcgggaaccggggccccagcctgcgcaccacgaccgcctccggcaagctcatcaccgagtggtgctgccggagctgcaccctgccgcccctgcgctaccgcggggaggacggctgctggtacgggatggagatccgccccctcaaggagaaggaggagaacctggtgaactccctggtgacggccggccacgggcagatcgacaacttcagcctcggcgtcctgggcatggcgctgttcctcgaggagatgctgcggacccgcgtggggaccaagcacgccgtgctgctcgtcgccgtgtccttcatgaccctgatcacgggcaacatgagcttccgggacctggggcgcgtgatggtcatggtgggcgccgccatgaccgacgacatcgggatgggcgtgacctacctcgcgctgctggccgccttcaaggtccgccccaccttcgccgccggcctcctgctgcggaagctcacgtccaaggagctgatgatgaccaccatcgggatcgtgctgctcagccagtccaccatcccggagacgatcctggagctgaccgacgcgctcgccctgggcatgatgatcctgaagatcgtgcgcaacatggagaagtaccagctcgccgtcaccatcatggccatcctgtgcgtgcccaacgccgtcatcctgcagaacgcgtggaaggtgagctgcaccatcctcgccgtggtctccgtgagccccctgctgctcacgtccagccagcagaaggccgactggatccccctggccctgaccatcaaggggctcaacccgaccgcgatcttcctgaccacgctgtcccggaccaacaagaagcgcagctggcccctcaacgaggccatcatggccgtgggcatggtctccatcctggccagctccctgctcaagaacgacatccccatgaccggccccctggtggccgggggcctgctcaccgtgtgctacgtcctgacggggcggagcgcggacctggagctcgagcgcgccgccgacgtgcggtgggaggaccaggccgagatcagcggctccagcccgatcctgtccatcaccatcagcgaggacgggtccatgagcatcaagaacgaggaggaggagcagaccctgaccatcctcatccgcacgggcctgctggtgatctccggcctcttccccgtcagcatccccatcaccgccgcggcctggtacctgtgggaggtgaagaagcagcgggccggggtgctgtgggacgtcccctccccgccgcccgtgggcaaggccgagctcgaggacggggcctaccgcatcaagcagaagggcatcctggggtacagccagatcggcgcgggcgtgtacaaggaggggaccttccacaccatgtggcacgtcacccggggcgccgtgctgatgcacaaggggaagcgcatcgagccgtcctgggccgacgtgcggaaggacctcatcagctacggcgggggctggaagctggagggcgagtggaaggagggggaggaggtccaggtgctggccctcgagcccggcaagaacccccgcgccgtgcagacgaagcccgggctgttcaagaccaacaccggcaccatcggggcggtctccctggacttcagcccgggcacgtccggcagccccatcgtggacaagaaggggaaggtggtcggcctctacgggaacggcgtggtgacccggtccggcacctacgtcagcgccatcgcccagaccgagaagtccatcgaggacaaccccgagatcgaggacgacatcttccgcaagaagcggctgacgatcatggacctgcaccccggggccggcaagaccaagcgctacctgccggcgatcgtgcgggaggccatcaagcgcgggctccggaccctgatcctggcccccacccgcgtggtcgccgccgagatggaggaggcgctccgcggcctgcccatccggtaccagacgcccgccatccgcgccgagcacaccgggcgggagatcgtggacctgatgtgccacgccaccttcaccatgcgcctcctgagcccggtgcgggtccccaactacaacctgatcatcatggacgaggcccacttcacggaccccgcgagcatcgccgcccgcggctacatctccacccgggtggagatgggcgaggccgccgggatcttcatgaccgcgacgccgcccggcagccgcgaccccttcccccagtccaacgcccccatcatggacgaggagcgggagatccccgagcgcagctggaactccgggcacgagtgggtgacggacttcaagggcaagaccgtctggttcgtgcccagcatcaaggccgggaacgacatcgccgcgtgcctccggaagaacggcaagaaggtgatccagctgtcccgcaagaccttcgacagcgagtacatcaagacccggacgaacgactgggacttcgtcgtgaccaccgacatctccgagatgggcgccaacttcaaggccgagcgcgtgatcgacccccggcgctgcatgaagcccgtcatcctgaccgacggggaggagcgggtgatcctcgccggcccgatgcccgtgacgcacagctccgccgcgcagcgccgggggcgcatcggccgcaaccccaagaacgagaacgaccagtacatctacatgggggagcccctggagaacgacgaggactgcgcccactggaaggaggccaagatgctgctcgacaacatcaacaccccggagggcatcatccccagcatgttcgagcccgagcgggagaaggtcgacgccatcgacggcgagtaccgcctgcgcggggaggcccgcaagaccttcgtggacctgatgcggcgcggcgacctcccggtgtggctggcgtaccgggtcgccgccgaggggatcaactacgccgaccgccggtggtgcttcgacggcatcaagaacaaccagatcctggaggagaacgtggaggtcgagatctggaccaaggagggggagcgcaagaagctcaagccccggtggctggacgcccgcatctactccgaccccctggcgctcaaggagttcaaggagttcgccgccggccgcaagagcctgacgctgaacctcatcaccgagatgggccgcctgcccaccttcatgacccagaaggcccggaacgcgctggacaacctcgccgtgctgcacacggccgaggccgggggccgcgcctacaaccacgcgctgtccgagctcccggagaccctggagaccctgctcctgctgaccctcctggccacggtgaccgggggcatcttcctgttcctcatgagcggcaaggggatcggcaagatgaccctggggatgtgctgcatcatcaccgcctccatcctgctctggtacgcccagatccagccccactggatcgccgcgagcatcatcctggagttcttcctgatcgtcctcctgatccccgagcccgagaagcagcggaccccgcaggacaaccagctgacgtacgtggtgatcgccatcctcaccgtcgtggccgccaccatggccaacgagatgggcttcctggagaagaccaagaaggacttcgggctgggctccatcgcgacgcagcagctcgagagcaacatcctggacatcgacctgcgccccgccagcgcctggaccctctacgccgtggccaccaccttcatcacgcccatgctgcggcactccatcgagaacagctccgtcaacgtgagcctgaccgcgatcgccaaccaggccaccgtgctcatgggcctggggaagggctggcccctgtccaagatggacatcggggtcccgctcctggccatcggctgctacagccaggtgaaccccatcaccctgacggcggccctcctgctgctcgtggcccactacgccatcatcgggcccggcctgcaggccaaggcgacccgcgaggcccagaagcgggccgccgccggcatcatgaagaaccccaccgtcgacgggatcaccgtgatcgacctggacccgatcccctacgaccccaagttcgagaagcagctcggccaggtgatgctgctggtcctctgcgtgacccaggtgctgatgatgcgcaccacctgggcgctgtgcgaggccctcaccctggccacggggcccatctccaccctgtgggagggcaacccggggcgcttctggaacaccaccatcgccgtcagcatggccaacatcttccggggctcctacctcgcgggcgccgggctgctgttcagcatcatgaagaacacgaccaacacccgccggggcaccgggaacacgggcgagaccctcggcgagaagtggaagaaccgcctgaactccctgggcaagagcgagttccagatctacaagcggtccggcatccaggaggtggaccgcaccctcgccaaggaggggatcaagcggggcgagaccgaccaccacgccgtgagccgcgggtccgcgaagctgcggtggttcgtcgagcgcaacctggtgacgcccgagggcaaggtggtcgacctcggctgcgggcggggcgggtggagctactactgcggcgggctgaagaacgtgcgcgaggtgaagggcctgaccaagggcgggcccggccacgaggagcccatcccgatgtccacctacgggtggaacctcgtccggctgcagagcggcgtggacgtgttcttcacgccgcccgagaagtgcgacacgctgctctgcgacatcggggagtccagccccaacccgaccgtcgaggccggccgcaccctgcgggtgctgaacctcgtggagaactggctgaacaacgacacccagttctgcatcaaggtcctgaacccctacatgcccagcgtgatcgagaagatggaggccctgcagcgcaagtacggcggggccctcgtgcggaacccgctgtcccgcaacagcacccacgagatgtactgggtctccaacgccagcggcaacatcgtgtccagcgtgaacatgatctcccggatgctgatcaaccgcttcacgatgcgccacaagaaggcgacctacgagcccgacgtcgacctcgggagcggcacccggaacatcgggatcgagtccgagacccccaacctggacatcatcggcaagcgcatcgagaagatcaagcaggagcacgagacgagctggcactacgaccaggaccacccctacaagacctgggcctaccacggctcctacgagaccaagcagaccgggagcgcctccagcatggtgaacggcgtggtccggctgctcacgaagccgtgggacgtgatccccatggtgacccagatggccatgaccgacaccacgcccttcgggcagcagcgcgtcttcaaggagaaggtggacacccggacccaggagcccaaggagggcaccaagaagctgatgaagatcacggccgagtggctgtggaaggagctcggcaagaagaagaccccgcgcatgtgcacccgggaggagttcacccgcaaggtgcggtccaacgcggccctgggggccatcttcacggacgagaacaagtggaagtccgcccgcgaggccgtcgaggactcccggttctgggagctggtgaacaaggagcgcaacctccacctggagggcaagtgcgagacctgcgtctacaacatgatggggaagcgggagaagaagatcggcgagttcgggaaggcgaagggcagccgcgccatctggtacatgtggctgggcgcccggttcctcgagttcgaggccctggggttcctgaacgaggaccactggttctcccgcgagaacagcctcagcggcgtggagggggagggcctgcacaagctggggtacatcctccgggaggtgtccaagaaggagggcggcgcgatgtacgccgacgacaccgccgggtgggacacccgcatcacgctggaggacctgaagaacgaggagatggtcaccaaccacatggagggcgagcacaagaagctcgccgaggccatcttcaagctgacctaccagaacaaggtggtgcgggtccagcgccccacgccccgggggacggtgatggacatcatcagccgccgcgaccagcggggctccggccaggtggggacctacggcctgaacaccttcaccaacatgggggcgcagctcatccgccagatggagggcgagggggtcttcaagggcatccagcacctgacggccaccgaggagaccgccgtgcacgactggctggcccgggtgggccgcgagcggctcagccgcatggccatctccggggacgactgcgtcgtgaagcccctggacgaccggttcgcgagcgccctgaccgccctcaacgacatgggcaaggtgcgcaaggacatccagcagtgggagccgtcccgggggtggaacgactggacgcaggtccccttctgcagccaccacttccacgagctgatcatgaaggacggccgcgtgctggtggtcccctgccggaaccaggacgagctcatcgggcgcgcccggatctcccagggcgccggctggagcctgcgcgagaccgcgtgcctggggaagtcctacgcccagatgtggagcctcatgtacttccaccggcgcgacctgcggctggccgccaacgccatctgctccgcggtgcccagccactgggtgccgacctcccgcaccacctggagcatccacgcccggcacgagtggatgacgaccgaggacatgctcaccgtctggaaccgcgtgtggatccaggagaacccctggatggaggacaagacccccgtggagtcctgggaggagatcccctacctgggcaagcgcgaggaccagtggtgcgggagcctgatcggcctcacgagccgggccacctgggccaagaacatccagaccgcgatcaaccaggtccgctccctgatcgggagcgaggagtacaccgactacatgccgtccatgaagcggttccgccgggaggaggaggaggccggcgtgctgtggtga

SEQ ID NO: 9700 - RNA, 9876 nt, synthetic construct
  misc_feature 1..9876: note = derived and/or modified CDS sequence (opt1) from DENV-2__KR779782__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgagcaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaaggccgggaacgacatcgccgcctgcctccggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctgacggacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtcgccacgaccttcatcacccccatgctccgccacagcatcgagaactccagcgtgaacgtgtccctgaccgccatcgccaaccaggcgacggtcctgatgggcctcgggaagggctggcccctgagcaagatggacatcggggtgccgctgctcgccatcggctgctactcccaggtgaaccccatcaccctgaccgccgccctgctcctgctggtcgcgcactacgccatcatcgggcccggcctccaggccaaggccacccgggaggcccagaagcgcgcggccgccggcatcatgaagaaccccacggtggacgggatgaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgcgaccgggcccatcagcaccctgtgggagggcaacccggggcgcttctggaacacgaccatcgccgtgtccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctgggcaagagcgagttccagatctacaagaagtccggcatccaggaggtggaccgcaccctggccaaggaggggatcaagcggggcgagacggaccaccacgccgtcagccgcgggtccgcgaagctccggtggttcgtggagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacgcacgagatgtactgggtgtccaacgccagcggcaacatcgtgtccagcgtcaacatgatctcccgcatgctgatcaaccggttcaccatgcgccacaagaaggcgacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctgaccaagccgtgggacgtgatccccatggtcacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgctccaacgcggccctcggggccatcttcaccgacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtggtccgggtgcagcgccccacgccccggggcaccgtgatggacatcatcagccgccgggaccagcgcgggtccggccaggtcgtgacctacggcctgaacaccttcacgaacatggaggcgcagctcatccggcagatggagggggagggcgtgttcaagagcatccagcagctgaccgtcaaggaggagatcgccgtgaagaactggctgatccgcgtggggcgcgagcggctctcccgcatggccatcagcggcgacgactgcgtcgtgaagcccctggacgaccggttcgcctccgccctgaccgcgctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagacggcctgcctgggcaagagctacgcccagatgtggtccctcatgtacttccaccggcgcgacctgcggctggcggccaacgccatctgcagcgccgtgccctcccactgggtgccgaccagccgcaccacctggtccatccacgccacccacgagtggatgacgaccgaggacatgctcaccgtctggaaccgggtgtggatccaggagaacccctggatggaggacaagacccccgtggagagctgggaggagatcccctacctgggcaagcgcgaggaccagtggtgcgggagcctgatcggcctcacgtcccgggcgacctgggccaagaacatccagaccgccatcaaccaggtccgcagcctgatcgggaacgaggagtacaccgactacatgccgtccatgaagcggttccgccgcgaggaggaggaggccggcgtgctgtggtga

SEQ ID NO: 9701 - RNA, 9876 nt, synthetic construct
  misc_feature 1..9876: note = derived and/or modified CDS sequence (opt1) from DENV-2__KM279608__SS-prME
  source 1..9876: mol_type = other RNA
accgccggcatcatcatcatgatgatccccaccgtgatggccttccacctgaccacccggaacggggagccccacatgatcgtgagccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgtcaccggcgagcaccggcgcgagaagcggagcgtggccctggtgccccacgtcggcatggggctggagacgcgcaccgagacctggatgtccagcgagggcgcctggaagcacgcccagcggatcgagacctggatcctccgccaccccgggttcacgatcatggccgcgatcctggcctacaccatcggcaccacctacctgcagcgggtgctcatcttcatcctgctgacggccgtgaccccctccatggccatgcgctgcatcgggatcagcaaccgggacttcgtcgagggcgtgtccggcgggagctgggtggacatcgtcctcgagcacggctcctgcgtgaccaccatggcgaagaacaagcccacgctggacttcgagctgatcaagaccgaggccaagcaccccgccaccctccgcaagtactgcgtggaggccaagctgaccaacacgaccaccgccagccggtgcccgacccagggggagccctccctgaacgaggagcaggacaagcgcttcgtctgcaagcacagcatggtggaccggggctggggcaacgggtgcggcctcttcgggaagggcgggatcgtgacgtgcgcgatgttcacgtgcaagaagaacatggagggcaaggtcgtgcagcccgagaacctggagtacaccatcgtgatcacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccgcaccggcctcgacttcaacgagatggtcctgctgcagatggagaacaaggcctggctcgtgcaccggcagtggttcctggacctgcccctcccctggctgccgggcgccgacacccaggggtccaactggatccagaaggagaccctggtcacgttcaagaacccccacgcgaagaagcaggacgtggtggtcctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtgaaggagatcgccgagacccagcacggcaccatcgtcatccgcgtgcagtacgagggggacggcagcccctgcaagatccccttcgagatcatggacctggagaagcggcacgtgctcggccgcctgatcacggtcaacccgatcgtgaccgagaaggacaaccccgtgaacatcgaggcggagccgcccttcggggactcctacatcatcatcggcgtcgagccggggcagctgaagctcagctggtacaagaagggctccagcatcgggcagatgttcgagaccaccatgcgcggcgccaagcggatggccatcctgggcgacacggcctgggacttcgggtccctgggcggggtgttcaccagcatcggcaaggccctccaccaggtgttcggggcgatctacggcgccgccttctccggcgtcagctggaccatgaagatcctgatcggggtggtgatcacctggatcggcatgaactcccgcagcacgtccctgagcgtctccctggtgctcgtgggggtcgtgaccctgtacctgggcgtgatggtccaggccgacagcgggtgcgtggtgtcctggcggaacaaggagctcaagtgcggcagcggcatcttcatcaccgacaacgtccacacctggacggagcagtacaagttccagcccgagagcccctccaagctggcgagcgccatccagaaggcccacgaggaggggatctgcggcatccgctccgtgacccggctggagaacctcatgtggaagcagatcacccccgagctgaaccacatcctgaccgagaacgaggtgaagctcacgatcatgaccggggacatcaagggcatcatgcaggccgggaagcgcagcctgcggccgcagcccaccgagctgaagtactcctggaaggcctggggcaaggcgaagatgctcagcaccgagctgcacaaccacacgttcctgatcgacggccccgagaccgccgagtgcccgaacaccaaccgcgcctggaactccctcgaggtcgaggactacgggttcggcgtgttcaccacgaacatctggctgaagctgaaggagcggcaggacgtgttctgcgacagcaagctcatgtccgccgccatcaaggacaaccgcgcggtccacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggccccgtgagccagcacaactaccggccggggtaccacacccagaccgcgggcccctggcacctggggcgcctggagatggacttcgacttctgcgagggcacgaccgtggtggtcaccgaggactgcgggaaccggggcccctccctccgcaccacgaccgccagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgacggccggccacgggcagatcgacaacttcagcctgggcgtcctgggcatggccctcttcctggaggagatgctgcggacccgcgtggggaccaagcacgcgatcctcctggtggccgtctccttcgtgaccctgatcacgggcaacatgagcttccgcgacctcgggcgggtgatggtcatggtgggcgccaccatgaccgacgacatcgggatgggcgtgacctacctggccctgctcgccgcgttcaaggtccgccccacgttcgccgccggcctgctgctccggaagctgacctccaaggagctgatgatgaccaccatcgggatcgtgctcctgagccagtccacgatccccgagagcatcctggagctcaccgacgccctggccctgggcatgatggtcctcaagatcgtgcgcaacatggagaagtaccagctggcggtgaccatcatggccatcctgtgcgtcccgaacgccgtgatcctcgagaacgcctggaaggtgtcctgcaccacgctggccgtcgtgagcgtgagccccctgctcctgaccagctcccagcagaaggcggactggatccccctggccctcaccatcaaggggctgaaccccaccgccatcttcctgacgaccctcagccggacctccaagaagcgcagctggccgctgaacgaggccatcatggcggtcggcatggtgtccatcctggccagctccctcctgaagaacgacatccccatgaccggccccctggtggccgggggcctcctgacggtctgctacgtgctgaccgggcggagcgccgacctcgagctggagcgcgccgcggacgtgcggtgggaggagcaggccgagatcagcggctccagccccatcctgtccatcaccatcagcgaggacgggtccatgagcatcaagaacgaggaggaggagcagaccctcacgatcctgatccgcaccggcctgctcgtcatctccggcctgttcccggtgagcatccccatcaccgccgccgcctggtacctgtgggaggtgaagaagcagcgggcgggggtcctctgggacgtgcccagcccgccgcccgtgggcaaggccgagctggaggacggggcctaccgcatcaagcagaagggcatcctggggtacagccagatcggcgccggcgtctacaaggaggggaccttccacaccatgtggcacgtgacgcggggcgccgtgctcatgcacaaggggaagcgcatcgagccctcctgggcggacgtcaagaaggacctgatcagctacggcgggggctggaagctggagggcgagtggaaggagggggaggaggtccaggtgctcgccctggagcccggcaagaacccccgggccgtccagaccaagcccgggctgttcaagaccaacaccggcacgatcggggccgtgtccctcgacttcagccccggcacctccggcagccccatcgtggacaagaaggggaaggtcgtgggcctgtacgggaacggcgtggtcacccgctccggcacctacgtgagcgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctcgcgccgacgcgcgtcgtggccgccgagatggaggaggccctgcggggcctgcccatccgctaccagacccccgccatccgggcggagcacaccgggcgcgagatcgtggacctcatgtgccacgccaccttcacgatgcggctgctgagccccatccgcgtcccgaactacaacctcatcatcatggacgaggcccacttcaccgaccccgccagcatcgccgcgcggggctacatctccacccgcgtggagatgggcgaggccgccgggatcttcatgaccgccacgccgcccggcagccgggacccgttcccccagtccaacgcccccatcatggacgaggagcgcgagatccccgagcggagctggaactccgggcacgagtgggtgaccgacttcaagggcaagaccgtctggttcgtgccgagcatcaaggcggggaacgacatcgccgcctgcctgcgcaagaacggcaagaaggtgatccagctgtcccggaagaccttcgacagcgagtacatcaagacgcgcaccaacgactgggacttcgtcgtgaccaccgacatctccgagatgggcgccaacttcaaggcggagcgggtgatcgacccccgccggtgcatgaagcccgtcatcctcacggacggggaggagcgcgtgatcctggccggccccatgccggtgacccacagctccgccgcccagcggcgcgggcgcgtcggccggaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgcgagaaggtggacgccatcgacggcgagtaccggctgcgcggggaggcccggaagaccttcgtcgacctcatgcgccggggcgacctgcccgtgtggctggcctacaaggtggccgcggaggggatcaactacgccgaccgccggtggtgcttcgacggcgtcaagaacaaccagatcctcgaggagaacgtggaggtggagatctggacgaaggagggggagcgcaagaagctgaagccgcggtggctggacgcccgcatctactccgaccccctcgccctgaaggagttcaaggagttcgccgcgggccggaagtccctgaccctcaacctgatcaccgagatgggccgcctgcccaccttcatgacgcagaaggccaagaacgccctcgacaacctggccgtcctgcacaccgcggaggccgggggccgggcctacaaccacgccctctccgagctgcccgagaccctggagaccctcctgctgctcacgctgctggccaccgtgaccgggggcatcttcctcttcctgatgagcggcaaggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacctacgtcgtgatcgccatcctgaccgtggtcgcggccaccatggccaacgagatgggcttcctggagaagacgaagaaggacttcgggctcggctccatcaccacccagcagccggagagcaacatcctggacatcgacctgcggcccgccagcgcctggaccctctacgcggtggccacgaccttcatcacccccatgctgcgccactccatcgagaacagctccgtgaacgtcagcctgaccgccatcgccaaccaggccacggtgctcatgggcctggggaagggctggcccctgtccaagatggacatcggggtgccgctcctggcgatcggctgctacagccaggtcaaccccatcaccctgaccgccgccctcctgctgctcgtggcccactacgcgatcatcgggcccggcctgcaggccaaggccacccgggaggcccagaagcgcgccgcggccggcatcatgaagaaccccacggtggacgggatcaccgtcatcgacctggacccgatcccctacgaccccaagttcgagaagcagctcggccaggtgatgctgctggtgctctgcgtcacccaggtgctgatgatgcggaccacgtgggccctgtgcgaggccctcaccctggccaccgggcccatctccaccctgtgggagggcaacccggggcgcttctggaacacgaccatcgcggtgagcatggccaacatcttccgcggctcctacctcgccggcgccgggctgctgttcagcatcatgaagaacaccgccaacacccggcgcggcacggggaacaccggcgagaccctcggcgagaagtggaagaaccggctgaacgcgctggggaagtccgagttccagatctacaagaagtccggcatccaggaggtcgaccgcaccctcgccaaggaggggatcaagcggggcgagacggaccaccacgccgtgtcccgcgggagcgccaagctgcggtggttcgtggagcgcaacctggtcacccccgagggcaaggtggtggacctcggctgcgggcggggcgggtggtcctactactgcggcgggctgaagaacgtcaaggaggtgaagggcctgaccaagggcgggcccggccacgaggagcccatcccgatgagcacctacgggtggaacctcgtgcgcctgcagtccggcgtcgacgtgttcttcacgccgcccgagaagtgcgacaccctgctctgcgacatcggggagagctcccccaacccgaccgtggaggcgggccggaccctgcgcgtcctgaacctcgtggagaactggctgaacaacaacacccagttctgcatcaaggtgctgaacccctacatgcccagcgtcatcgagaagatggaggccctgcagcggaagtacggcggggccctcgtgcgcaacccgctgagccggaactccacgcacgagatgtactgggtgagcaacgcctccggcaacatcgtcagctccgtgaacatgatcagccgcatgctgatcaaccggttcaccatgcgccacaagaaggccacctacgagcccgacgtggacctcgggtccggcacccggaacatcgggatcgagagcgagacgcccaacctggacatcatcggcaagcgcatcaagaagatcaagcaggagcacgagacctcctggcactacgaccaggaccacccctacaagacctgggcgtaccacggcagctacgagaccaagcagacggggtccgccagctccatggtcaacggcgtggtgcgcctgctcaccaagccgtgggacgtcatccccatggtgacccagatggccatgaccgacacgacccccttcgggcagcagcgggtcttcaaggagaaggtggacacccgcacccaggagcccaaggagggcacgaagaagctgatgaagatcaccgccgagtggctgtggaaggagctcggcaagaagaagaccccgcggatgtgcacccgcgaggagttcacgcggaaggtgcgcagcaacgccgcgctgggggccatcttcaccgacgagaacaagtggaagtccgcccgggaggccgtcgaggacagcggcttctgggagctggtggacaaggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgagaactccctgagcggggtcgagggcgaggggctgcacaagctcggctacatcctgcgggacgtgagcaagaaggagggcggggccatgtacgcggacgacaccgccggctgggacacgcgcatcaccctggaggacctcaagaacgaggagatggtgaccaaccacatggagggggagcacaagaagctggccgaggccatcttcaagctgacctaccagaacaaggtcgtgcgggtgcagcgccccacgccccggggcaccgtcatggacatcatctcccgccgggaccagcgcgggagcggccaggtggtgacctacggcctcaacaccttcacgaacatggaggcccagctgatccggcagatggagggggagggcgtcttcaagtccatccagcagctgaccgtgaaggaggagatcgcggtgaagaactggctcatccgcgtcgggcgcgagcggctgagccgcatggccatctccggcgacgactgcgtggtgaagcccctggacgaccggttcgccagcgccctcaccgccctgaacgacatgggcaaggtccgcaaggacatccagcagtgggagccgtcccgggggtggaacgactggacccaggtgcccttctgcagccaccacttccacgagctgatcatgaaggacggccgcgtgctcgtcgtgccctgccggaaccaggacgagctgatcgggcgcgcgcggatctcccagggcgccgggtggagcctgcgcgagacggcctgcctcggcaagtcctacgcccagatgtggagcctgatgtacttccaccggcgcgacctgcggctcgccgcgaacgccatctgctccgccgtgcccagccactgggtcccgacctcccgcaccacctggagcatccacgccacccacgagtggatgacgaccgaggacatgctgaccgtgtggaaccgggtgtggatccaggagaacccctggatggaggacaagacccccgtcgagtcctgggaggagatcccctacctgggcaagcgcgaggaccagtggtgcgggagcctcatcggcctgacgagccgggccacctgggcgaagaacatccagaccgccatcaaccaggtgcgctccctgatcgggaacgaggagtacaccgactacatgccgagcatgaagcggttccgccgcgaggaggaggaggccggcgtgctctggtga

SEQ ID NO: 9702 - RNA, 9876 nt, synthetic construct
  misc_feature 1..9876: note = derived and/or modified CDS sequence (opt1) from DENV-2__KM279605__SS-prME
  source 1..9876: mol_type = other RNA
accgccggcatcatcatcatgatgatccccaccgtgatggccttccacctgaccacccggaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggacaaccccgtgaacatcgaggccgagccgcccttcggggactcctacatcatcatcggcgtggagccggggcagctgaagctgagctggttcaagaagggctccagcatcgggcagatgttcgagaccaccatgcgcggcgccaagcggatggccatcctcggcgacacggcctgggacttcgggtccctgggcggggtcttcaccagcatcggcaaggcgctgcaccaggtgttcggggccatctacggcgccgccttctccggcgtgagctggaccatgaagatcctcatcggggtcgtgatcacctggatcggcatgaactcccgcagcacgtccctgagcgtgtccctggtcctggtgggggtggtcaccctctacctgggcgtgatggtgcaggcggacagcgggtgcgtcgtgtcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtcacccgcctggagaacctgatgtggaagcagatcacccccgagctcaaccacatcctgaccgagaacgaggtgaagctgacgatcatgaccggggacatcaagggcatcatgcaggccgggaagcggagcctccgcccgcagcccaccgagctgaagtactcctggaaggcgtggggcaaggccaagatgctgagcaccgagctccacaaccacacgttcctgatcgacggccccgagaccgccgagtgcccgaacaccaaccgggcctggaactccctggaggtggaggactacgggttcggcgtcttcaccacgaacatctggctcaagctgaaggagcgccaggacgtgttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtcgtggtgaccgaggactgcgggaaccgcggcccctccctgcggaccacgaccgccagcggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacgggcagatcgacaacttcagcctcggcgtgctgggcatggcgctgttcctcgaggagatgctgcgcacccgggtcgggaccaagcacgccatcctgctcgtggccgtgtccttcgtcaccctgatcacgggcaacatgagcttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcacctccaaggagctgatgatgaccaccatcgggatcgtcctgctcagccagtccacgatccccgagagcatcctggagctgaccgacgccctcgcgctgggcatgatggtgctgaagatcgtccggaacatggagaagtaccagctcgccgtgaccatcatggccatcctgtgcgtgccgaacgccgtcatcctggagaacgcctggaaggtgtcctgcaccacgctcgcggtggtcagcgtgagccccctgctgctcaccagctcccagcagaaggccgactggatccccctggccctgaccatcaaggggctcaaccccaccgccatcttcctgacgaccctgagccgcacctccaagaagcggagctggccgctcaacgaggcgatcatggccgtgggcatggtctccatcctggccagctccctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttcccggtcagcatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtacagccagatcggcgccggcgtgtacaaggaggggaccttccacaccatgtggcacgtcacgcgcggcgcggtgctgatgcacaaggggaagcggatcgagccctcctgggccgacgtgaagaaggacctcatcagctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtctccctggacttcagccccggcacctccggcagccccatcgtggacaagaaggggaaggtggtcggcctctacgggaacggcgtggtgacccggtccggcacctacgtcagcgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgccagcatcgcggcccgcggctacatctccacccgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctccggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctgacggacggggaggagcgggtcatcctcgccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtcgacgccatcgacggcgagtaccgcctgcgcggggaggcccgcaagaccttcgtggacctgatgcggcgcggcgacctccccgtctggctggcctacaaggtggcggccgaggggatcaactacgccgaccggcgctggtgcttcgacggcgtgaagaacaaccagatcctggaggagaacgtcgaggtggagatctggacgaaggagggggagcggaagaagctcaagccgcgctggctggacgcccggatctactccgaccccctggccctcaaggagttcaaggagttcgcggccggccgcaagagcctgaccctgaacctcatcaccgagatgggccggctgcccaccttcatgacgcagaaggccaagaacgccctggacaacctcgcggtgctgcacaccgccgaggccgggggccgcgcctacaaccacgccctgtccgagctccccgagaccctggagaccctgctcctgctgacgctcctggcgaccgtcaccgggggcatcttcctgttcctcatgagcggcaaggggatcggcaagatgaccctggggatgtgctgcatcatcaccgcctccatcctgctctggtacgcccagatccagccgcactggatcgccgccagcatcatcctggagttcttcctgatcgtgctcctgatccccgagcccgagaagcagcggacgccccaggacaaccagctgacctacgtggtcatcgcgatcctcaccgtggtggccgccaccatggccaacgagatgggcttcctggagaagacgaagaaggacttcgggctgggctccatcaccacccagcagccggagagcaacatcctcgacatcgacctgcgccccgccagcgcgtggaccctgtacgccgtcgccacgaccttcatcacccccatgctccggcactccatcgagaacagctccgtgaacgtgagcctgaccgccatcgccaaccaggcgacggtcctgatgggcctcgggaagggctggcccctgtccaagatggacatcggggtgccgctgctcgccatcggctgctacagccaggtgaaccccatcaccctgaccgccgccctgctcctgctggtcgcgcactacgccatcatcgggcccggcctccaggccaaggccacccgcgaggcccagaagcgggcggccgccggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcgcaccacgtgggccctgtgcgaggccctgaccctcgcgaccgggcccatctccaccctgtgggagggcaacccggggcggttctggaacacgaccatcgccgtgagcatggccaacatcttccgcggctcctacctggccggcgccgggctcctgttcagcatcatgaagaacaccgcgaacacccgccggggcacggggaacaccggcgagaccctgggcgagaagtggaagaaccgcctcaacgccctggggaagtccgagttccagatctacaagaagtccggcatccaggaggtggaccggaccctggccaaggaggggatcaagcgcggcgagacggaccaccacgccgtctcccgggggagcgcgaagctccgctggttcgtggagcggaacctggtgacccccgagggcaaggtcgtggacctgggctgcgggcgcggcgggtggtcctactactgcggcgggctcaagaacgtgaaggaggtcaagggcctgaccaagggcgggcccggccacgaggagcccatcccgatgagcacctacgggtggaacctggtgcggctccagtccggcgtggacgtcttcttcacgccgcccgagaagtgcgacaccctgctgtgcgacatcggggagagctcccccaacccgaccgtggaggccggccgcaccctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctcagccgcaactccacgcacgagatgtactgggtgagcaacgcctccggcaacatcgtgagctccgtcaacatgatcagccggatgctgatcaaccgcttcaccatgcggcacaagaaggcgacctacgagcccgacgtggacctggggtccggcacccgcaacatcgggatcgagagcgagacgcccaacctcgacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctgaccaagccgtgggacgtgatccccatggtcacccagatggccatgaccgacacgacccccttcgggcagcagcgcgtgttcaaggagaaggtcgacacccggacccaggagcccaaggagggcacgaagaagctcatgaagatcaccgccgagtggctgtggaaggagctgggcaagaagaagaccccgcgcatgtgcacccgggaggagttcacgcgcaaggtgcggagcaacgcggccctcggggccatcttcaccgacgagaacaagtggaagtccgcccgcgaggccgtggaggacagcggcttctgggagctggtcgacaaggagcggaacctgcacctcgaggggaagtgcgagacctgcgtgtacaacatgatgggcaagcgcgagaagaagctgggggagttcggcaaggcgaagggctcccgggccatctggtacatgtggctgggggcccgcttcctcgagttcgaggccctgggcttcctgaacgaggaccactggttcagccgggagaactccctcagcggggtggagggcgaggggctgcacaagctgggctacatcctccgcgacgtcagcaagaaggagggcggggcgatgtacgccgacgacaccgccggctgggacacgcggatcaccctggaggacctgaagaacgaggagatggtgaccaaccacatggagggggagcacaagaagctcgccgaggccatcttcaagctgacctaccagaacaaggtggtccgcgtgcagcggcccacgccccgcggcaccgtgatggacatcatctcccggcgcgaccagcgggggagcggccaggtcgtgacctacggcctgaacaccttcacgaacatggaggcgcagctcatccgccagatggagggggagggcgtgttcaagtccatccagcagctgaccgtcaaggaggagatcgccgtgaagaactggctgatccgggtggggcgcgagcgcctcagccggatggccatctccggcgacgactgcgtcgtgaagcccctggacgaccgcttcgccagcgccctgaccgcgctcaacgacatgggcaaggtgcggaaggacatccagcagtgggagccgtcccgcgggtggaacgactggacccaggtccccttctgcagccaccacttccacgagctgatcatgaaggacggccgggtgctggtggtcccctgccgcaaccaggacgagctcatcgggcgggcccgcatctcccagggcgccgggtggagcctgcgggagacggcctgcctgggcaagtcctacgcccagatgtggagcctcatgtacttccaccgccgggacctgcgcctggcggccaacgccatctgctccgccgtgcccagccactgggtgccgacctcccggaccacctggagcatccacgccacccacgagtggatgacgaccgaggacatgctcaccgtctggaaccgcgtgtggatccaggagaacccctggatggaggacaagacccccgtggagtcctgggaggagatcccctacctgggcaagcgggaggaccagtggtgcgggagcctgatcggcctcacgagccgcgcgacctgggccaagaacatccagaccgccatcaaccaggtccggtccctgatcgggaacgaggagtacaccgactacatgccgagcatgaagcgcttccggcgcgaggaggaggaggccggcgtgctgtggtga

SEQ ID NO: 9703 - RNA, 9876 nt, synthetic construct
  misc_feature 1..9876: note = derived and/or modified CDS sequence (opt1) from DENV-2__KM279609__SS-prME
  source 1..9876: mol_type = other RNA
accgcggggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcacctggccaccctccgcaagtactgcgtggaggccaagctgaccaacacgaccaccgcgagccggtgccccacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcacgccccagagctccatcaccgaggccgagctgaccggctacgggaccgtgacgatggagtgcagcccgcgcaccggcctcgacttcaacgagatggtgctgctgcagatggagaacaaggcctggctcgtccaccggcagtggttcctggacctgcccctcccctggctgcccggcgcggacacccaggggtccaactggatccagaaggagaccctggtgacgttcaagaacccgcacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaaccccatcgtcaccgagaaggactccccggtgaacatcgaggccgagccgcccttcggggacagctacatcatcatcggcgtggagcccgggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagccggagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccccagccgaccgagctgaagtacagctggaaggcgtggggcaaggccaagatgctctccaccgagctgcacaaccacacgttcctgatcgacggccccgagaccgccgagtgccccaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgccccgggtaccacacccagaccgccggcccgtggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgccgcccctccggtaccgcggggaggacggctgctggtacgggatggagatccggccgctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgcccaacgccgtcatcctccagaacgcctggaaggtgagctgcaccacgctggcggtggtctccgtgagcccgctgctcctgacctccagccagcagaaggccgactggatccccctggccctcaccatcaaggggctgaaccccaccgccatcttcctgacgaccctctcccgcaccagcaagaagcggtcctggcccctgaacgaggcgatcatggccgtgggcatggtcagcatcctggcctccagcctcctgaagaacgacatcccgatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttccccgtctccatcccgatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccgcgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtctccgcgatcgcccagacggagaagtccatcgaggacaacccggagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgcccccacgcgcgtggtcgccgccgagatggaggaggccctgcgcggcctgccgatccggtaccagacccccgcgatccgcgccgagcacaccgggcgggagatcgtggacctcatgtgccacgccaccttcacgatgcgcctgctgagccccatccgggtgcccaactacaacctcatcatcatggacgaggcccacttcaccgacccggcctccatcgcggcccgcggctacatcagcacccgggtcgagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtgaccgacttcaagggcaagaccgtgtggttcgtcccctccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccgcggcgctgcatgaagcccgtgatcctcacggacggggaggagcgggtcatcctggccggccccatgcccgtgacccactccagcgccgcccagcgccgggggcgcgtgggccgcaacccgaagaacgagaacgaccagtacatctacatgggggagcccctggagaacgacgaggactgcgcgcactggaaggaggccaagatgctcctggacaacatcaacacccccgagggcatcatcccctccatgttcgagccggagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccccggtggctggacgcccgcatctacagcgacccgctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctcagcgagctgcccgagaccctggagaccctcctgctgctcacgctgctggcgaccgtcaccgggggcatcttcctcttcctgatgtccggcaaggggatcggcaagatgaccctggggatgtgctgcatcatcaccgccagcatcctcctgtggtacgcccagatccagccccactggatcgccgcctccatcatcctggagttcttcctcatcgtgctgctgatcccggagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagcccgagagcaacatcctggacatcgacctgcggccggcctccgcgtggaccctctacgccgtcgccacgaccttcatcacccccatgctgcgccacagcatcgagaactccagcgtgaacgtgtccctgaccgccatcgccaaccaggcgacggtcctcatgggcctggggaagggctggcccctgagcaagatggacatcggggtgcccctcctggccatcggctgctactcccaggtgaacccgatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggaccccatcccgtacgaccccaagttcgagaagcagctcggccaggtcatgctgctggtgctctgcgtgacccaggtcctgatgatgcggaccacgtgggccctgtgcgaggccctcaccctggcgaccgggcccatcagcaccctgtgggagggcaaccccgggcgcttctggaacacgaccatcgccgtgtccatggccaacatcttccgcggcagctacctcgccggcgccgggctgctgttctccatcatgaagaacaccgcgaacacccggcgcggcacggggaacaccggcgagaccctcggcgagaagtggaagaaccggctgaacgccctgggcaagagcgagttccagatctacaagaagtccggcatccaggaggtggaccgcaccctcgccaaggaggggatcaagcggggcgagacggaccaccacgccgtcagccgcgggtccgcgaagctgcggtggttcgtggagcgcaacctggtgaccccggagggcaaggtcgtggacctcggctgcgggcggggcgggtggagctactactgcggcgggctgaagaacgtgaaggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagtccagccccaaccccaccgtggaggccggccggaccctgcgcgtgctgaacctcgtcgagaactggctgaacaacaacacccagttctgcatcaaggtgctgaacccgtacatgcccagcgtgatcgagaagatggaggccctgcagcggaagtacggcggggccctcgtccgcaaccccctgtcccggaacagcacgcacgagatgtactgggtgtccaacgccagcggcaacatcgtgtccagcgtcaacatgatctcccgcatgctgatcaaccggttcaccatgcgccacaagaaggcgacctacgagccggacgtggacctcgggagcggcacccggaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtgatcccgatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgcggccctgggggccatcttcaccgacgagaacaagtggaagtccgcccgggaggccgtggaggactccggcttctgggagctggtcgacaaggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgagcggggtggagggcgaggggctgcacaagctcggctacatcctgcgggacgtctccaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgcccgacgccccggggcaccgtgatggacatcatcagccgccgggaccagcgcgggtccggccaggtcgtgacctacggcctcaacaccttcacgaacatggaggcgcagctgatccggcagatggagggggagggcgtgttcaagagcatccagcagctgaccgtcaaggaggagatcgccgtgaagaactggctcatccgcgtggggcgcgagcggctgtcccgcatggccatcagcggcgacgactgcgtcgtgaagcccctggacgaccggttcgcctccgccctcaccgcgctgaacgacatgggcaaggtgcgcaaggacatccagcagtgggagcccagccgggggtggaacgactggacccaggtcccgttctgctcccaccacttccacgagctgatcatgaaggacggccgcgtgctcgtggtcccctgccggaaccaggacgagctgatcgggcgcgcccggatcagccagggcgccgggtggtccctgcgcgagacggcctgcctcggcaagagctacgcccagatgtggtccctgatgtacttccaccggcgcgacctgcggctcgcggccaacgccatctgcagcgccgtgccctcccactggatccccaccagccgcaccacctggtccatccacgccacccacgagtggatgacgaccgaggacatgctgaccgtgtggaaccgggtctggatccaggagaacccgtggatggaggacaagacccccgtggagagctgggaggagatcccctacctgggcaagcgcgaggaccagtggtgcgggagcctcatcggcctgacgtcccgggcgacctgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9704 - RNA, 9876 nt, synthetic construct
  misc_feature 1..9876: note = derived and/or modified CDS sequence (opt1) from DENV-2__KM279607__SS-prME
  source 1..9876: mol_type = other RNA
accgcgggcatcatcatcatgatgatccccaccgtgatggccttccacctgaccacccggaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacctgcagcgggtcctcatcttcatcctgctgacggccgtgaccccctccatggcgatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcaccccgccaccctccgcaagtactgcgtggaggccaagctgaccaacacgaccaccgcgagccggtgcccgacccagggggagccctccctgaacgaggagcaggacaagcgcttcgtgtgcaagcacagcatggtcgaccggggctggggcaacgggtgcggcctcttcgggaagggcgggatcgtgacgtgcgccatgttcacgtgcaagaagaacatggagggcaaggtggtccagcccgagaacctggagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctcgacttcaacgagatggtgctgctgcagatggagaacaaggcctggctcgtccaccggcagtggttcctggacctgcccctcccctggctgccgggcgcggacacccaggggtccaactggatccagaaggagaccctggtgacgttcaagaacccccacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaacccgatcgtcaccgagaaggacaaccccgtgaacatcgaggccgagccgcccttcggggactcctacatcatcatcggcgtggagccggggcagctgaagctcagctggtacaagaagggctccagcatcgggcagatgttcgagaccaccatgcgcggcgccaagcggatggccatcctgggcgacacggcctgggacttcgggtccctgggcggggtcttcaccagcatcggcaaggcgctccaccaggtgttcggggccatctacggcgccgccttctccggcgtgagctggaccatgaagatcctgatcggggtcgtgatcacctggatcggcatgaactcccgcagcacgtccctgagcgtgtccctggtcctcgtgggggtggtcaccctgtacctgggcgtgatggtgcaggcggacagcgggtgcgtcgtgtcctggaagaacaaggagctcaagtgcggcagcggcatcttcatcaccgacaacgtgcacacctggacggagcagtacaagttccagcccgagagcccctccaagctggccagcgccatccagaaggcccacgaggaggggatctgcggcatccggtccgtcacccgcctggagaacctcatgtggaagcagatcacccccgagctgaaccacatcctgaccgagaacgaggtgaagctcacgatcatgaccggggacatcaagggcatcatgcaggccgggaagcggagcctgcgcccgcagcccaccgagctgaagtactcctggaaggcgtggggcaaggccaagatgctcagcaccgagctgcacaaccacacgttcctgatcgacggccccgagaccgccgagtgcccgaacaccaaccgggcctggaactccctcgaggtggaggactacgggttcggcgtcttcaccacgaacatctggctgaagctgaaggagcgccaggacgtgttctgcgacagcaagctcatgtccgccgcgatcaaggacaaccgggccgtgcacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgcgggccccgtgagccagcacaactaccgcccggggtaccacacccagaccgccggcccctggcacctggggcggctggagatggacttcgacttctgcgagggcacgaccgtcgtggtgaccgaggactgcgggaaccgcggcccctccctccggaccacgaccgccagcggcaagctgatcaccgagtggtgctgccgcagctgcaccctgcccccgctccggtaccgcggggaggacggctgctggtacgggatggagatccggcccctgaaggagaaggaggagaacctggtcaactccctcgtgacggccggccacgggcagatcgacaacttcagcctgggcgtgctgggcatggccctcttcctggaggagatgctgcgcacccgggtcgggaccaagcacgccatcctcctggtggccgtgtccttcgtcaccctgatcacgggcaacatgagcttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgacctccaaggagctgatgatgaccaccatcgggatcgtcctcctgagccagtccacgatccccgagagcatcctggagctcaccgacgccctggcgctgggcatgatggtgctcaagatcgtccggaacatggagaagtaccagctggccgtgaccatcatggccatcctgtgcgtgccgaacgccgtcatcctcgagaacgcctggaaggtgtcctgcaccacgctggcggtggtcagcgtgagccccctgctcctgaccagctcccagcagaaggccgactggatccccctggccctcaccatcaaggggctgaaccccaccgccatcttcctgacgaccctcagccgcacctccaagaagcggagctggccgctgaacgaggcgatcatggccgtgggcatggtctccatcctggccagctccctcctgaagaacgacatccccatgaccggccccctggtggccgggggcctcctgacggtgtgctacgtcctgaccgggcgcagcgccgacctcgagctggagcgggcggccgacgtgcgctgggaggagcaggccgagatcagcggctccagccccatcctgtccatcaccatcagcgaggacgggtccatgagcatcaagaacgaggaggaggagcagaccctcacgatcctgatccggaccggcctgctcgtgatctccggcctgttcccggtcagcatccccatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacgcgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacaccggcacgatcggggccgtctccctcgacttcagccccggcacctccggcagccccatcgtggacaagaaggggaaggtggtcggcctgtacgggaacggcgtggtgacccggtccggcacctacgtcagcgcgatcgcccagacggagaagtccatcgaggacaaccccgagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgccccgacgcgcgtggtcgccgccgagatggaggaggccctgcgcggcctgcccatccggtaccagacccccgcgatccgcgccgagcacaccgggcgggagatcgtggacctcatgtgccacgccaccttcacgatgcgcctgctgagccccatccgggtgccgaactacaacctcatcatcatggacgaggcccacttcaccgaccccgccagcatcgcggcccgcggctacatctccacccgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctgcggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctcacggacggggaggagcgggtcatcctggccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgggagaaggtcgacgccatcgacggcgagtaccgcctgcgcggggaggcccgcaagaccttcgtggacctcatgcggcgcggcgacctgcccgtctggctggcctacaaggtggcggccgaggggatcaactacgccgaccggcgctggtgcttcgacggcgtgaagaacaaccagatcctcgaggagaacgtcgaggtggagatctggacgaaggagggggagcggaagaagctgaagccgcgctggctggacgcccggatctactccgaccccctcgccctgaaggagttcaaggagttcgcggccggccgcaagagcctgaccctcaacctgatcaccgagatgggccggctgcccaccttcatgacgcagaaggccaagaacgccctcgacaacctggcggtgctgcacaccgccgaggccgggggccgcgcctacaaccacgccctctccgagctgcccgagaccctggagaccctcctgctgctcacgctgctggcgaccgtcaccgggggcatcttcctcttcctgatgagcggcaaggggatcggcaagatgaccctggggatgtgctgcatcatcaccgcctccatcctcctgtggtacgcccagatccagccgcactggatcgccgccagcatcatcctggagttcttcctcatcgtgctgctgatccccgagcccgagaagcagcggacgccccaggacaaccagctcacctacgtggtcatcgcgatcctgaccgtggtggccgccaccatggccaacgagatgggcttcctggagaagacgaagaaggacttcgggctcggctccatcaccacccagcagccggagagcaacatcctggacatcgacctgcgccccgccagcgcgtggaccctctacgccgtcgccacgaccttcatcacccccatgctgcggcactccatcgagaacagctccgtgaacgtgagcctgaccgccatcgccaaccaggcgacggtcctcatgggcctggggaagggctggcccctgtccaagatggacatcggggtgccgctcctggccatcggctgctacagccaggtgaaccccatcaccctgaccgccgccctcctgctgctcgtcgcgcactacgccatcatcgggcccggcctgcaggccaaggccacccgcgaggcccagaagcgggcggccgccggcatcatgaagaaccccacggtggacgggatcaccgtgatcgacctggacccgatcccctacgaccccaagttcgagaagcagctcggccaggtcatgctgctggtgctctgcgtgacccaggtcctgatgatgcgcaccacgtgggccctgtgcgaggccctcaccctggcgaccgggcccatctccaccctgtgggagggcaacccggggcggttctggaacacgaccatcgccgtgagcatggccaacatcttccgcggctcctacctcgccggcgccgggctgctgttcagcatcatgaagaacaccgcgaacacccgccggggcacggggaacaccggcgagaccctcggcgagaagtggaagaaccgcctgaacgccctggggaagtccgagttccagatctacaagaagtccggcatccaggaggtggaccggaccctcgccaaggaggggatcaagcgcggcgagacggaccaccacgccgtctcccgggggagcgcgaagctgcgctggttcgtggagcggaacctggtgacccccgagggcaaggtcgtggacctcggctgcgggcgcggcgggtggtcctactactgcggcgggctgaagaacgtgaaggaggtcaagggcctgaccaagggcgggcccggccacgaggagcccatcccgatgagcacctacgggtggaacctcgtgcggctgcagtccggcgtggacgtcttcttcacgccgcccgagaagtgcgacaccctgctctgcgacatcggggagagctcccccaacccgaccgtggaggccggccgcaccctgcgggtgctgaacctcgtcgagaactggctgaacaacaacacccagttctgcatcaaggtgctgaacccctacatgcccagcgtgatcgagaagatggaggccctgcagcgcaagtacggcggggccctcgtccggaacccgctgagccgcaactccacgcacgagatgtactgggtgagcaacgcctccggcaacatcgtgagctccgtcaacatgatcagccggatgctgatcaaccgcttcaccatgcggcacaagaaggcgacctacgagcccgacgtggacctcgggtccggcacccgcaacatcgggatcgagagcgagacgcccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtcgtgaagctgctcaccaagccgtgggacgtgatccccatggtcacccagatggccatgaccgacacgacccccttcgggcagcagcgcgtgttcaaggagaaggtcgacacccgcacccaggagcccaaggagggcacgaagaagctgatgaagatcaccgccgagtggctgtggaaggagctcggcaagaagaagaccccgcggatgtgcacccgcgaggagttcacgcggaaggtgcgcagcaacgcggccctgggggccatcttcaccgacgagaacaagtggaagtccgcccgggaggccgtggaggacagcggcttctgggagctggtcgacaaggagcgcaacctccacctggaggggaagtgcgagacctgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgagaactccctgagcggggtggagggcgaggggctgcacaagctcggctacatcctgcgggacgtcagcaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgccccacgccccggggcaccgtgatggacatcatctcccgccgggaccagcgcgggagcggccaggtcgtgacctacggcctcaacaccttcacgaacatggaggcgcagctgatccggcagatggagggggagggcgtgttcaagtccatccagcagctgaccgtcaaggaggagatcgccgtgaagaactggctcatccgcgtggggcgggagcgcctgagccgcatggccatctccggcgacgactgcgtcgtgaagcccctggacgaccggttcgccagcgccctcaccgcgctgaacgacatgggcaaggtgcgcaaggacatccagcagtgggagccgtcccgggggtggaacgactggacccaggtccccttctgcagccaccacttccacgagctgatcatgaaggacggccgcgtgctcgtggtcccctgccggaaccaggacgagctgatcgggcgcgcccggatctcccagggcgccgggtggagcctgcgcgagacggcctgcctcggcaagtcctacgcccagatgtggagcctgatgtacttccaccggcgcgacctgcggctcgcggccaacgccatctgctccgccgtgcccagccactgggtgccgacctcccgcaccacctggagcatccacgccacccacgagtggatgacgaccgaggacatgctgaccgtctggaaccgggtgtggatccaggagaacccctggatggaggacaagacccccgtggagtcctgggaggagatcccctacctgggcaagcgcgaggaccagtggtgcgggagcctcatcggcctgacgagccgggcgacctgggccaagaacatccagaccgccatcaaccaggtccgctccctgatcgggaacgaggagtacaccgactacatgccgagcatgaagcggttccgccgggaggaggaggaggccggcgtgctctggtga

SEQ ID NO: 9705 - RNA, 9876 nt, synthetic construct
  misc_feature 1..9876: note = derived and/or modified CDS sequence (opt1) from DENV-2__KM279606__SS-prME
  source 1..9876: mol_type = other RNA
accgccggcatcatcatcatgatgatccccaccgtgatggccttccacctgaccacccggaacggggagccccacatgatcgtctcccggcaggagaagggcaagtccctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggacaaccccgtgaacatcgaggccgagccgcccttcggggactcctacatcatcatcggcgtggagccggggcagctgaagctgagctggtacaagaagggctccagcatcgggcagatgttcgagaccaccatgcgcggcgccaagcggatggccatcctcggcgacacggcctgggacttcgggtccctgggcggggtcttcaccagcatcggcaaggcgctgcaccaggtgttcggggccatctacggcgccgccttctccggcgtgagctggaccatgaagatcctcatcggggtcgtgatcacctggatcggcatgaactcccgcagcacgtccctgagcgtgtccctggtcctggtgggggtggtcaccctctacctgggcgtgatggtgcaggcggacagcgggtgcgtcgtgtcctggaagaacaaggagctgaagtgcggcagcggcatcttcatcaccgacaacgtgcacacctggacggagcagtacaagttccagcccgagagcccctccaagctcgccagcgccatccagaaggcccacgaggaggggatctgcggcatccggtccgtcacccgcctggagaacctgatgtggaagcagatcacccccgagctcaaccacatcctgaccgagaacgaggtgaagctgacgatcatgaccggggacatcaagggcatcatgcaggccgggaagcggagcctccgcccgcagcccaccgagctgaagtactcctggaaggcgtggggcaaggccaagatgctgagcaccgagctccacaaccacacgttcctgatcgacggccccgagaccgccgagtgcccgaacaccaaccgggcctggaactccctggaggtggaggactacgggttcggcgtcttcaccacgaacatctggctcaagctgaaggagcgccaggacgtgttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtcgtggtgaccgaggactgcgggaaccgcggcccctccctgcggaccacgaccgccagcggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacgggcagatcgacaacttcagcctcggcgtgctgggcatggcgctgttcctcgaggagatgctgcgcacccgggtcgggaccaagcacgccatcctgctcgtggccgtgtccttcgtcaccctgatcacgggcaacatgagcttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcacctccaaggagctgatgatgaccaccatcgggatcgtcctgctcagccagtccacgatccccgagagcatcctggagctgaccgacgccctcgcgctgggcatgatggtgctgaagatcgtccggaacatggagaagtaccagctcgccgtgaccatcatggccatcctgtgcgtgccgaacgccgtcatcctggagaacgcctggaaggtgtcctgcaccacgctcgcggtggtcagcgtgagccccctgctgctcaccagctcccagcagaaggccgactggatccccctggccctgaccatcaaggggctcaaccccaccgccatcttcctgacgaccctgagccgcacctccaagaagcggagctggccgctcaacgaggcgatcatggccgtgggcatggtctccatcctggccagctccctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttcccggtcagcatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtacagccagatcggcgccggcgtgtacaaggaggggaccttccacaccatgtggcacgtcacgcgcggcgcggtgctgatgcacaaggggaagcggatcgagccctcctgggccgacgtgaagaaggacctcatcagctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtctccctggacttcagccccggcacctccggcagccccatcgtggacaagaaggggaaggtggtcggcctctacgggaacggcgtggtgacccggtccggcacctacgtcagcgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgccagcatcgcggcccgcggctacatctccacccgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctccggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctgacggacggggaggagcgggtcatcctcgccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtcgacgccatcgacggcgagtaccgcctgcgcggggaggcccgcaagaccttcgtggacctgatgcggcgcggcgacctccccgtctggctggcctacaaggtggcggccgaggggatcaactacgccgaccggcgctggtgcttcgacggcgtgaagaacaaccagatcctggaggagaacgtcgaggtggagatctggacgaaggagggggagcggaagaagctcaagccgcgctggctggacgcccggatctactccgaccccctggccctcaaggagttcaaggagttcgcggccggccgcaagagcctgaccctgaacctcatcaccgagatgggccggctgcccaccttcatgacgcagaaggccaagaacgccctggacaacctcgcggtgctgcacaccgccgaggccgggggccgcgcctacaaccacgccctgtccgagctccccgagaccctggagaccctgctcctgctgacgctcctggcgaccgtcaccgggggcatcttcctgttcctcatgagcggcaaggggatcggcaagatgaccctggggatgtgctgcatcatcaccgcctccatcctgctctggtacgcccagatccagccgcactggatcgccgccagcatcatcctggagttcttcctgatcgtgctcctgatccccgagcccgagaagcagcggacgccccaggacaaccagctgacctacgtggtcatcgcgatcctcaccgtggtggccgccaccatggccaacgagatgggcttcctggagaagacgaagaaggacttcgggctgggctccatcaccacccagcagccggagagcaacatcctcgacatcgacctgcgccccgccagcgcgtggaccctgtacgccgtcgccacgaccttcatcacccccatgctccggcactccatcgagaacagctccgtgaacgtgagcctgaccgccatcgccaaccaggcgacggtcctgatgggcctcgggaagggctggcccctgtccaagatggacatcggggtgccgctgctcgccatcggctgctacagccaggtgaaccccatcaccctgaccgccgccctgctcctgctggtcgcgcactacgccatcatcgggcccggcctccaggccaaggccacccgcgaggcccagaagcgggcggccgccggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcgcaccacgtgggccctgtgcgaggccctgaccctcgcgaccgggcccatctccaccctgtgggagggcaacccggggcggttctggaacacgaccatcgccgtgagcatggccaacatcttccgcggctcctacctggccggcgccgggctcctgttcagcatcatgaagaacaccgcgaacacccgccggggcacggggaacaccggcgagaccctgggcgagaagtggaagaaccgcctcaacgccctggggaagtccgagttccagatctacaagaagtccggcatccaggaggtggaccggaccctggccaaggaggggatcaagcgcggcgagacggaccaccacgccgtctcccgggggagcgcgaagctccgctggttcgtggagcggaacctggtgacccccgagggcaaggtcgtggacctgggctgcgggcgcggcgggtggtcctactactgcggcgggctcaagaacgtgaaggaggtcaagggcctgaccaagggcgggcccggccacgaggagcccatcccgatgagcacctacgggtggaacctggtgcggctccagtccggcgtggacgtcttcttcacgccgcccgagaagtgcgacaccctgctgtgcgacatcggggagagctcccccaacccgaccgtggaggccggccgcaccctccgggtgctgaacctggccgagaactggctcaacaacaacacccagttctgcatcaaggtcctgaacccctacatgcccagcgtgatcgagaagatggaggccctgcagcgcaagtacggcggggccctggtgcggaacccgctcagccgcaactccacgcacgagatgtactgggtcagcaacgcgtccggcaacatcgtgagctccgtgaacatgatcagccggatgctgatcaaccgcttcaccatgcggcacaagaaggccacctacgagcccgacgtcgacctggggtccggcacccgcaacatcgggatcgagagcgagacgcccaacctcgacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtggtccgcctgctgaccaagccgtgggacgtgatccccatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagaccccgcgcatgtgcacccgggaggagttcacgcgcaaggtccggagcaacgccgccctcggggccatcttcaccgacgagaacaagtggaagtccgcccgcgaggcggtggaggacagcggcttctgggagctggtggacaaggagcggaacctgcacctcgaggggaagtgcgagacctgcgtctacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaactccctcagcggggtggagggcgaggggctgcacaagctgggctacatcctccgcgacgtgagcaagaaggagggcggggccatgtacgccgacgacaccgccggctgggacacgcggatcaccctggaggacctgaagaacgaggagatggtcaccaaccacatggagggggagcacaagaagctcgccgaggcgatcttcaagctgacctaccagaacaaggtggtgcgcgtccagcggcccacgccccgcggcaccgtgatggacatcatctcccggcgcgaccagcgggggagcggccaggtggtcacctacggcctgaacaccttcacgaacatggaggcccagctcatccgccagatggagggggagggcgtgttcaagtccatccagcagctgaccgtgaaggaggagatcgccgtcaagaactggctgatccgggtggggcgcgagcgcctcagccggatggccatctccggcgacgactgcgtggtcaagcccctggacgaccgcttcgccagcgcgctgaccgccctcaacgacatgggcaaggtgcggaaggacatccagcagtgggagccgtcccgcgggtggaacgactggacccaggtgcccttctgcagccaccacttccacgagctgatcatgaaggacggccgggtcctggtggtgccctgccgcaaccaggacgagctcatcgggcgggcccgcatctcccagggcgccgggtggagcctgcgggagacggcctgcctgggcaagtcctacgcgcagatgtggagcctcatgtacttccaccgccgggacctgcgcctggccgccaacgccatctgctccgccgtccccagccactgggtgccgacctcccggaccacctggagcatccacgcgacccacgagtggatgacgaccgaggacatgctcaccgtgtggaaccgcgtctggatccaggagaacccctggatggaggacaagacccccgtggagtcctgggaggagatcccctacctgggcaagcgggaggaccagtggtgcgggagcctgatcggcctcacgagccgcgccacctgggccaagaacatccagaccgccatcaaccaggtgcggtccctgatcgggaacgaggagtacaccgactacatgccgagcatgaagcgcttccggcgcgaggaggaggaggcgggcgtcctgtggtga

SEQ ID NO: 9706 - RNA, 9876 nt, synthetic construct
  misc_feature 1..9876: note = derived and/or modified CDS sequence (opt1) from DENV-2__JN851113__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaaggccgggaacgacatcgccgcctgcctccggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctgacggacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtcgccacgaccttcatcacccccatgctccgccacagcatcgagaactccagcgtgaacgtgtccctgaccgccatcgccaaccaggcgacggtcctgatgggcctcgggaagggctggcccctgagcaagatggacatcggggtgccgctgctcgccatcggctgctactcccaggtgaaccccatcaccctgaccgccgccctgctcctgctggtcgcgcactacgccatcatcgggcccggcctccaggccaaggccacccgggaggcccagaagcgcgcggccgccggcatcatgaagaaccccacggtggacgggatgaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgcgaccgggcccatcagcaccctgtgggagggcaacccggggcgcttctggaacacgaccatcgccgtgtccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctgggcaagagcgagttccagatctacaagaagtccggcatccaggaggtggaccgcaccctggccaaggaggggatcaagcggggcgagacggaccaccacgccgtcagccgcgggtccgcgaagctccggtggttcgtggagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacgcacgagatgtactgggtgtccaacgccagcggcaacatcgtgtccagcgtcaacatgatctcccgcatgctgatcaaccggttcaccatgcgccacaagaaggcgacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctgaccaagccgtgggacgtgatccccatggtcacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgctccaacgcggccctcggggccatcttcaccgacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtggtccgggtgcagcgccccacgccccggggcaccgtgatggacatcatcagccgccgggaccagcgcgggtccggccaggtcgtgacctacggcctgaacaccttcacgaacatggaggcgcagctcatccggcagatggagggggagggcgtgttcaagagcatccagcagctgaccgtcaaggaggagatcgccgtgaagaactggctgatccgcgtggggcgcgagcggctctcccgcatggccatcagcggcgacgactgcgtcgtgaagcccctggacgaccggttcgcctccgccctgaccgcgctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagacggcctgcctgggcaagagctacgcccagatgtggtccctcatgtacttccaccggcgcgacctgcggctggcggccaacgccatctgcagcgccgtgccctcccactgggtgccgaccagccgcaccacctggtccatccacgccacccacgagtggatgacgaccgaggacatgctcaccgtctggaaccgggtgtggatccaggagaacccctggatggaggacaagacccccgtggagagctgggaggagatcccctacctgggcaagcgcgaggaccagtggtgcgggagcctgatcggcctcacgtcccgggcgacctgggccaagaacatccagaccgccatcaaccaggtccgcagcctgatcgggaacgaggagtacaccgactacatgccgtccatgaagcggttccgccgcgaggaggaggaggccggcgtgctgtggtga

SEQ ID NO: 9707 - RNA, 9876 nt, synthetic construct
  misc_feature 1..9876: note = derived and/or modified CDS sequence (opt1) from DENV-2__GU370050__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaaggccgggaacgacatcgccgcctgcctccggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctgacggacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtcgccacgaccttcatcacccccatcctccgccacagcatcgagaactccagcgtgaacgtgtccctgaccgccatcgccaaccaggcgacggtcctgatgggcctcgggaagggctggcccctgagcaagatggacatcggggtgccgctgctcgccatcggctgctactcccaggtgaaccccatcaccctgaccgccgccctgctcctgctggtcgcgcactacgccatcatcgggcccggcctccaggccaaggccacccgggaggcccagaagcgcgcggccgccggcatcatgaagaaccccacggtggacgggatgaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgcgaccgggcccatcagcaccctgtgggagggcaacccggggcgcttctggaacacgaccatcgccgtgtccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctgggcaagagcgagttccagatctacaagaagtccggcatccaggaggtggaccgcaccctggccaaggaggggatcaagcggggcgagacggaccaccacgccgtcagccgcgggtccgcgaagctccggtggttcgtggagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacgcacgagatgtactgggtgtccaacgccagcggcaacatcgtgtccagcgtcaacatgatctcccgcatgctgatcaaccggttcaccatgcgccacaagaaggcgacctacgagcccgacgtggacctggggagcggcacccggaacatcgggatcgagtccgagacgcccaacctcgacatcatcggcaagcgcatcgagaagatcaagcaggagcacaagaccagctggcactacgaccaggaccacccctacaagacctgggcctaccacggctcctacgagaccaagcagacggggagcgcctccagcatggtgaacggcgtcgtgcgcctgctgaccaagccgtgggacgtgatccccatggtcacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgctccaacgcggccctcggggccatcttcaccgacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacgcgcatcaccctggaggacctgaagaacgaggagatggtgaccaaccacatggagggggagcacaagaagctcgccgaggccatcttccggctgacctaccagaacaaggtggtccgcgtgcagcggcccacgccccgcggcaccgtgatggacatcatcagccggcgcgaccagcgggggtccggccaggtcgtgacctacggcctgaacaccttcacgaacatggaggcgcagctcatccgccagatggagggggagggcgtgttcaagagcatccagcagctgaccgtcaaggaggagatcgccgtgaagaactggctgatccgcgtggggcgggagcgcctctcccggatggccatcagcggcgacgactgcgtcgtgaagcccctggacgaccgcttcgcctccgccctgaccgcgctcaacgacatgggcaaggtgcggaaggacatccagcagtgggagccgagccgcgggtggaacgactggacccaggtccccttctgctcccaccacttccacgagctgatcatgaaggacggccgggtgctggtggtcccctgccgcaaccaggacgagctcatcgggcgggcccgcatcagccagggcgccgggtggtccctgcgggagacggcctgcctgggcaagagctacgcccagatgtggtccctcatgtacttccaccgccgggacctgcgcctggcggccaacgccatctgcagcgccgtgccctcccactgggtgccgaccagccggaccacctggtccatccacgccacccacgagtggatgacgaccgaggacatgctcaccgtctggaaccgcgtgtggatccaggagaacccctggatggaggacaagacccccgtggagagctgggaggagatcccctacctgggcaagcgggaggaccagtggtgcgggagcctgatcggcctcacgtcccgcgcgacctgggccaagaacatccagaccgccatcaaccaggtccggagcctgatcgggaacgaggagtacaccgactacatgccgtccatgaagcgcttccgccgggaggaggaggaggccggcgtgctgtggtga

SEQ ID NO: 9708 - RNA, 9876 nt, synthetic construct
  misc_feature 1..9876: note = derived and/or modified CDS sequence (opt1) from DENV-2__JN851129__SS-prME
  source 1..9876: mol_type = other RNA
accgcggggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacacgatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgagcgaggagcaggacaagcgcttcgtgtgcaagcactccatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccacagcggcgaggagaacgccgtggggaacgacacgggcaagcacgggaaggagatcaaggtcaccccgcagtccagcatcaccgaggccgagctgaccggctacgggaccgtgacgatggagtgcagcccccggaccggcctggacttcaacgagatggtgctcctgcagatggagaacaaggcctggctggtccaccggcagtggttcctcgacctgcccctgccctggctcccgggcgcggacacccaggggagcaactggatccagaaggagaccctggtgacgttcaagaacccccacgccaagaagcaggacgtcgtggtgctgggcagccaggagggggccatgcacaccgccctcaccggcgccaccgagatccagatgtccagcgggaacctgctgttcacgggccacctcaagtgccgcctgcggatggacaagctgcagctcaagggcatgtcctacagcatgtgcaccgggaagttcaaggtcgtgaaggagatcgcggagacccagcacggcaccatcgtgatccgcgtccagtacgagggggacggctccccctgcaagatccccttcgagatcatggacctggagaagcggcacgtgctgggccgcctcatcacggtgaacccgatcgtcaccgagaaggacagccccgtgaacatcgaggccgagccgcccttcggggactcctacatcatcatcggcgtggagccggggcagctgaagctgagctggttcaagaagggctccagcatcgggcagatgttcgagaccaccatgcgcggcgccaagcggatggccatcctcggcgacacggcctgggacttcgggtccctgggcggggtcttcaccagcatcggcaaggcgctgcaccaggtgttcggggccatctacggcgccgccttctccggcgtgagctggaccatgaagatcctcatcggggtcgtgatcacctggatcggcatgaactcccgcagcacgtccctgagcgtgtccctggtcctggtgggggtggtcaccctctacctgggcgtgatggtgcaggcggacagcgggtgcgtcgtgagctggaagaacaaggagctgaagtgcggctccggcatcttcatcaccgacaacgtgcacacctggacggagcagtacaagttccagcccgagagcccctccaagctcgccagcgccatccagaaggcccacgaggaggggatctgcggcatccggtccgtcacccgcctggagaacctgatgtggaagcagatcacccccgagctcaaccacatcctgagcgagaacgaggtgaagctgaccatcatgacgggggacatcaagggcatcatgcaggccgggaagcggtccctccgcccgcagcccaccgagctgaagtacagctggaaggcgtggggcaaggccaagatgctgtccaccgagctccacaaccacaccttcctgatcgacggccccgagacggccgagtgcccgaacaccaaccgggcctggaacagcctggaggtggaggactacgggttcggcgtcttcaccaccaacctctggctgaagctgaaggagcgccaggacgtgttctgcgactccaagctcatgagcgccgcgatcaaggacaaccgggccgtgcacgccgacatggggtactggatcgagtccgccctgaacgacacgtggaagatcgagaaggccagcttcatcgaggtcaagtcctgccactggcccaagagccacaccctgtggtccaacggcgtgctcgagagcgagatgatcatccccaagagcttcgcgggccccgtgtcccagcacaactaccgcccggggtaccacacccagaccgccggcccctggcacctggggcggctggagatggacttcgacttctgcgagggcaccacggtcgtggtgaccgaggactgcgggaaccgcggccccagcctccggaccaccacggcctccggcaagctgatcaccgagtggtgctgccgcagctgcaccctgcccccgctccggtaccgcggggaggacggctgctggtacgggatggagatccggcccctgaaggagaaggaggagaacctggtcaactccctcgtgaccgccggccacgggcagatcgacaacttcagcctgggcgtgctgggcatggccctcttcctggaggagatgctgcgcacgcgggtcgggaccaagcacgccatcctcctggtggccgtgtccttcgtcaccctgatcaccggcaacatgagcttccgcgacctcgggcgcgtgatggtgatggtcggcgccacgatgaccgacgacatcgggatgggcgtgacctacctggccctgctcgcggccttcaaggtgcggcccaccttcgccgccggcctgctgctccgcaagctgacgtccaaggagctgatgatgaccaccatcgggatcgtcctcctgagccagtccaccatccccgagacgatcctggagctcaccgacgccctggcgctgggcatgatggtgctcaagatcgtccggaacatggagaagtaccagctggccgtgaccatcatggccatcctgtgcgtgccgaacgccgtcatcctccagaacgcctggaaggtgagctgcaccacgctggcggtggtctccgtgagccccctgctcctgacctccagccagcagaaggccgactggatccccctggccctcaccatcaaggggctgaaccccaccgccatcttcctgacgaccctctcccgcaccagcaagaagcggtcctggccgctgaacgaggcgatcatggccgtgggcatggtcagcatcctggccagctccctcctgaagaacgacatccccatgaccggccccctggtggccgggggcctcctgacggtgtgctacgtcctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtgatcagcggcctgttcccggtctccatccccatcaccgccgccgcgtggtacctgtgggaggtgaagaagcagcgcgccggggtgctctgggacgtcccctccccgccgcccgtgggcaaggccgagctggaggacggggcctaccggatcaagcagaagggcatcctggggtactcccagatcggcgccggcgtgtacaaggaggggaccttccacaccatgtggcacgtcacgcgcggcgcggtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccccgcgccgtgcagaccaagcccgggctgttcaagaccaacaccggcacgatcggggccgtcagcctcgacttctcccccggcaccagcggctcccccatcgtggacaagaaggggaaggtggtcggcctgtacgggaacggcgtggtgacccggagcggcacctacgtcagcgcgatcgcccagacggagaagtccatcgaggacaaccccgagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgccccgacgcgcgtggtcgccgccgagatggaggaggccctgcgcggcctgcccatccggtaccagacccccgcgatccgcgccgagcacaccgggcgggagatcgtggacctcatgtgccacgccaccttcacgatgcgcctgctgagccccatccgggtgccgaactacaacctcatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaaggccgggaacgacatcgccgcctgcctgcggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctcacggacggggaggagcgggtcatcctggccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcatcaagaacaaccagatcctcgaggagaacgtggaggtcgagatctggacgaaggagggggagcgcaagaagctgaagccgcggtggctggacgcccgcatctacagcgaccccctcgccctgaaggagttcaaggagttcgcggccggccggaagtccctgaccctcaacctgatcaccgagatgggccgcctgcccaccttcatgacgcagaaggcccggaacgccctcgacaacctggcggtgctgcacaccgccgaggccgggggccgcgcctacaaccacgccctcagcgagctgcccgagaccctggagaccctcctgctgctcacgctgctggcgaccgtgaccgggggcatcttcctcttcctgatgtccggcaaggggatcggcaagatgaccctggggatgtgctgcatcatcaccgccagcatcctcctgtggtacgcccagatccagccgcactggatcgccgccagcatcatcctggagttcttcctcatcgtcctgctgatccccgagcccgagaagcagcggacgccccaggacaaccagctcacctacgtggtgatcgcgatcctgaccgtcgtggccgccaccatggccaacgagatgggcttcctggagaagacgaagaaggacttcgggctcggctccatcaccacccagcagccggagagcaacatcctggacatcgacctgcgccccgcctccgcgtggaccctctacgccgtggccacgaccttcatcacccccatgctgcggcacagcatcgagaactccagcgtcaacgtgtccctgaccgccatcgccaaccaggcgacggtgctcatgggcctggggaagggctggcccctgagcaagatggacatcggggtcccgctcctggccatcggctgctactcccaggtgaaccccatcaccctgaccgccgccctcctgctgctcgtggcgcactacgccatcatcgggcccggcctgcaggccaaggccacccgcgaggcccagaagcgggcggccgccggcatcatgaagaaccccacggtcgacgggatcaccgtgatcgacctggacccgatcccctacgaccccaagttcgagaagcagctcggccaggtgatgctgctggtcctctgcgtgacccaggtgctgatgatgcgcaccacgtgggccctgtgcgaggccctcaccctggcgaccgggcccatcagcaccctgtgggagggcaacccggggcgcttctggaacacgaccatcgccgtctccatggccaacatcttccggggcagctacctcgccggcgccgggctgctgttctccatcatgaagaacaccgcgaacacccgccggggcacggggaacaccggcgagaccctcggcgagaagtggaagaaccgcctgaacgccctgggcaagagcgagttccagatctacaagaagtccggcatccaggaggtggaccggaccctcgccaaggaggggatcaagcgcggcgagacggaccaccacgccgtgagccgggggtccgcgaagctgcgctggttcgtcgagcggaacctggtgacccccgagggcaaggtggtcgacctcggctgcgggcgcggcgggtggagctactactgcggcgggctgaagaacgtgaaggaggtgaagggcctgaccaagggcgggcccggccacgaggagcccatcccgatgtccacctacgggtggaacctcgtccggctgcagagcggcgtggacgtgttcttcacgccgcccgagaagtgcgacaccctgctctgcgacatcggggagagctcccccaacccgaccgtcgaggccggccgcaccctgcgggtgctgaacctcgtggagaactggctgaacaacaacacccagttctgcatcaaggtcctgaacccctacatgcccagcgtgatcgagaagatggaggccctgcagcgcaagtacggcggggccctcgtgcggaacccgctgtcccgcaacagcacgcacgagatgtactgggtctccaacgccagcggcaacatcgtgtccagcgtgaacatgatctcccggatgctgatcaaccgcttcaccatgcggcacaagaaggcgacctacgagcccgacgtcgacctcgggagcggcacccgcaacatcgggatcgagtccgagacgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtggtccggctgctcaccaagccgtgggacatcatccccatggtgacccagatggccatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagaccccgcgcatgtgcacccgggaggagttcacgcgcaaggtgcggtccaacgcggccctgggggccatcttcaccgacgagaacaagtggaagtccgcccgcgaggccgtcgaggactccggcttctgggagctggtggacaaggagcggaacctccacctggaggggaagtgcgagacctgcgtgtacaacatgatgggcaagcgcgagaagaagctgggggagttcggcaaggcgaagggcagccgggccatctggtacatgtggctcggggcccgcttcctggagttcgaggccctgggcttcctcaacgaggaccactggttcagccgggagaactccctgagcggggtcgagggcgaggggctgcacaagctcggctacatcctgcgcgacgtgtccaagaaggagggcggggcgatgtacgccgacgacaccgccggctgggacacgcggatcaccctggaggacctcaagaacgaggagatggtgaccaaccacatggagggggagcacaagaagctggccgaggccatcttcaagctgacctaccagaacaaggtcgtgcgcgtgcagcggcccacgccccgcggcaccgtcatggacatcatcagccggcgcgaccagcgggggtccggccaggtggtgacctacggcctcaacaccttcacgaacatggaggcgcagctgatccgccagatggagggggagggcgtcttcaagagcatccagcagctgaccgtgaccgaggagatcgccgtgaagaactggctcgtccgcgtggggcgggagcgcctgtcccggatggccatcagcggcgacgactgcgtggtcaagcccctggacgaccgcttcgcctccgccctcaccgcgctgaacgacatgggcaaggtgcggaaggacatccagcagtgggagccgagccgcgggtggaacgactggacccaggtgcccttctgctcccaccacttccacgagctgatcatgaaggacggccgggtcctcgtggtgccctgccgcaaccaggacgagctgatcgggcgggcccgcatcagccagggcgccgggtggtccctgcgggagaccgcctgcctcggcaagagctacgcccagatgtggtccctgatgtacttccaccgccgggacctgcgcctcgcggccaacgccatctgcagcgccgtcccctcccactgggtgccgaccagccggaccacctggagcatccacgccacgcacgagtggatgaccaccgaggacatgctgaccgtgtggaaccgcgtctggatccaggagaacccctggatggaggacaagacgctggtggagtcctgggaggagatcccctacctcggcaagcgggaggaccagtggtgcgggagcctgatcggcctgacctcccgcgcgacctgggccaagaacatccagaccgccatcaaccaggtgcggagcctcatcgggaacgaggagtacacggactacatgccctccatgaagcgcttccgccgggaggaggaggaggccggcgtcctgtggtga

SEQ ID NO: 9709 - RNA, 9876 nt, synthetic construct
  misc_feature 1..9876: note = derived and/or modified CDS sequence (opt1) from DENV-2__JN851128__SS-prME
  source 1..9876: mol_type = other RNA
accgccggcatcatcatcatgatgatccccaccgtgatggccttccacctgaccacccgcaacggggagccccacatgatcgtcagccggcaggagaagggcaagtccctcctgttcaagaccgagaacggggtgaacatgtgcaccctgatggcgatggacctcggcgagctgtgcgaggacacgatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaaccaccccgccaccctgcgcaagtactgcatcgaggccaagctcaccaacacgaccaccgcgagccggtgcccgacccagggggagccctccctgagcgaggagcaggacaagcgcttcgtgtgcaagcactccatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccacagcggcgaggagaacgccgtggggaacgacacgggcaagcacgggaaggagatcaaggtcaccccgcagtccagcatcaccgaggccgagctgaccggctacgggaccgtgacgatggagtgcagcccccggaccggcctggacttcaacgagatggtgctcctgcagatggagaacaaggcctggctggtccaccggcagtggttcctcgacctgcccctgccctggctcccgggcgcggacacccaggggagcaactggatccagaaggagaccctggtgacgttcaagaacccccacgccaagaagcaggacgtcgtggtgctgggcagccaggagggggccatgcacaccgccctcaccggcgccaccgagatccagatgtccagcgggaacctgctgttcacgggccacctcaagtgccgcctgcggatggacaagctgcagctcaagggcatgtcctacagcatgtgcaccgggaagttcaaggtcgtgaaggagatcgcggagacccagcacggcaccatcgtgatccgcgtccagtacgagggggacggctccccctgcaagatccccttcgagatcatggacctggagaagcggcacgtgctgggccgcctcatcacggtgaacccgatcgtcaccgagaaggacagccccgtgaacatcgaggccgagccgcccttcggggactcctacatcatcatcggcgtggagccggggcagctgaagctgagctggttcaagaagggctccagcatcgggcagatgttcgagaccaccatgcgcggcgccaagcggatggccatcctcggcgacacggcctgggacttcgggtccctgggcggggtcttcaccagcatcggcaaggcgctgcaccaggtgttcggggccatctacggcgccgccttctccggcgtgagctggaccatgaagatcctcatcggggtcgtgatcacctggatcggcatgaactcccgcagcacgtccctgagcgtgtccctggtcctggtgggggtggtcaccctctacctgggcgtgatggtgcaggcggacagcgggtgcgtcgtgagctggaagaacaaggagctgaagtgcggctccggcatcttcatcaccgacaacgtgcacacctggacggagcagtacaagttccagcccgagagcccctccaagctcgccagcgccatccagaaggcccacgaggaggggatctgcggcatccggtccgtcacccgcctggagaacctgatgtggaagcagatcacccccgagctcaaccacatcctgagcgagaacgaggtgaagctgaccatcatgacgggggacatcaagggcatcatgcaggccgggaagcggtccctccgcccgcagcccaccgagctgaagtacagctggaaggcgtggggcaaggccaagatgctgtccaccgagctccacaaccacaccttcctgatcgacggccccgagacggccgagtgcccgaacaccaaccgggcctggaacagcctggaggtggaggactacgggttcggcgtcttcaccaccaacctctggctgaagctgaaggagcgccaggacgtgttctgcgactccaagctcatgagcgccgcgatcaaggacaaccgggccgtgcacgccgacatggggtactggatcgagtccgccatcaacgacacgtggaagatcgagaaggccagcttcatcgaggtcaagtcctgccactggcccaagagccacaccctgtggtccaacggcgtgctggagagcgagatgatcatccccaagaacttcgcgggccccgtgagccagcacaactaccgcccggggtaccacacccagaccgccggcccctggcacctcgggcggctggagatggacttcgacttctgcgagggcaccacggtcgtggtgaccgaggactgcgggaaccgcggcccctccctgcggaccaccacggccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgaccgccggccacgggcagatcgacaacttctccctcggcgtgctgggcatggcgctgttcctcgaggagatgctgcgcacgcgggtcgggaccaagcacgccatcctgctcgtggccgtgagcttcgtcaccctgatcaccggcaacatgtccttccgcgacctggggcgcgtgatggtgatggtcggcgccacgatgaccgacgacatcgggatgggcgtgacctacctcgccctgctggcggccttcaaggtgcggcccaccttcgccgccggcctcctgctgcgcaagctcacgagcaaggagctgatgatgaccaccatcgggatcgtcctgctctcccagagcaccatccccgagacgatcctggagctgaccgacgccctcgcgctgggcatgatgatcctgaagatcgtgcggaacatggagaagtaccagctcgccgtcaccatcatggccatcctgtgcgtgccgaacgccgtgatcctgcagaacgcctggaaggtctcctgcaccacgctcgcggtggtgagcgtcagccccctgctgctcaccagctcccagcagaaggccgactggatccccctggccctgaccatcaaggggctcaaccccaccgccatcttcctgacgaccctgagccgcacctccaagaagcggagctggccgctcaacgaggcgatcatggccgtgggcatggtgtccatcctggccagcagcctgctcaagaacgacatccccatgaccggccccctggtcgccgggggcctgctcacggtgtgctacgtgctgaccgggcgctccgccgacctggagctcgagcgggcggccgacgtccgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttcccggtgagcatccccatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtacagccagatcggcgccggcgtgtacaaggaggggaccttccacaccatgtggcacgtgacgcgcggcgcggtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggccgtgtccctggacttcagccccggcacctccggcagccccatcgtcgacaagaaggggaaggtggtgggcctctacgggaacggcgtcgtgacccggtccggcacctacgtgagcgcgatcgcccagacggagaagtccatcgaggacaaccccgagatcgaggacgacatcttccgcaagaagcggctgaccatcatggacctgcaccccggggccggcaagaccaagcgctacctgcccgccatcgtccgggaggcgatcaagcgcgggctccggaccctgatcctggccccgacgcgcgtggtggccgccgagatggaggaggccctccgcggcctgcccatccggtaccagacccccgcgatccgcgccgagcacaccgggcgggagatcgtcgacctgatgtgccacgccaccttcacgatgcgcctcctgtcccccatccgggtgccgaactacaacctgatcatcatggacgaggcccacttcaccgaccccgccagcatcgcggcccgcggctacatctccacccgggtggagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtcaccgacttcaagggcaagaccgtgtggttcgtgccgagcatcaaggccgggaacgacatcgccgcctgcctccggaagaacggcaagaaggtcatccagctgtcccgcaagaccttcgacagcgagtacatcaagacgcggaccaacgactgggacttcgtggtgaccaccgacatctccgagatgggcgcgaacttcaaggccgagcgcgtcatcgacccccggcgctgcatgaagcccgtgatcctgacggacggggaggagcgggtgatcctcgccggccccatgccggtcacccacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcctaccgggtcgcggccgaggggatcaactacgccgaccgccggtggtgcttcgacggcgtgaagaacaaccagatcctggaggagaacgtggaggtcgagatctggacgaaggagggggagcgcaagaagctcaagccgcggtggctggacgcccgcatctactccgaccccctggccctcaaggagttcaaggagttcgcggccggccggaagtccctgaccctgaacctcatcaccgagatgggccgcctgcccaccttcatgacgcagaaggcccggaacgccctggacaacctcgcggtgctgcacaccgccgaggccgggggccgcgcctacaaccacgccctgtccgagctccccgagaccctggagaccctgctcctgctgacgctcctggcgaccgtgaccgggggcatcttcctgttcctcatgagcggcaaggggatcggcaagatgaccctggggatgtgctgcatcatcaccgcctccatcctgctctggtacgcccagatccagccgcactggatcgccgccagcatcatcctggagttcttcctgatcgtcctcctgatccccgagcccgagaagcagcggacgccccaggacaaccagctgacctacgtggtgatcgcgatcctcaccgtcgtggccgccaccatggccaacgagatgggcttcctggagaagacgaagaaggacttcgggctgggcagcatcaccacccagcagccggagtccaacatcctcgacatcgacctgcgccccgccagcgcgtggaccctgtacgccgtggccacgaccttcatcacccccatgctccggcactccatcgagaacagctccgtcaacgtgagcctgaccgccatcgccaaccaggcgacggtgctgatgggcctcgggaagggctggcccctgtccaagatggacatcggggtcccgctgctcgccatcggctgctacagccaggtgaaccccatcaccctgaccgccgccctgctcctgctggtggcgcactacgccatcatcgggcccggcctccaggccaaggccacccgcgaggcccagaagcgggcggccgccggcatcatgaagaaccccacggtcgacgggatcaccgtgatcgacctggacccgatcccctacgaccccaagttcgagaagcagctgggccaggtgatgctcctggtcctgtgcgtgacccaggtgctcatgatgcgcaccacgtgggccctgtgcgaggccctgaccctcgcgaccgggcccatctccaccctgtgggagggcaacccggggcgcttctggaacacgaccatcgccgtcagcatggccaacatcttccggggctcctacctggccggcgccgggctcctgttcagcatcatgaagaacaccgcgaacacccgccggggcacggggaacaccggcgagaccctgggcgagaagtggaagaaccgcctcaacgccctggggaagtccgagttccagatctacaagaagtccggcatccaggaggtggaccggaccctggccaaggaggggatcaagcgcggcgagacggaccaccacgccgtgtcccgggggagcgcgaagctccgctggttcgtcgagcggaacctggtgacccccgagggcaaggtggtcgacctgggctgcgggcgcggcgggtggtcctactactgcggcgggctcaagaacgtgaaggaggtgaagggcctgaccaagggcgggcccggccacgaggagcccatcccgatgagcacctacgggtggaacctggtccggctccagtccggcgtggacgtgttcttcacgccgcccgagaagtgcgacaccctgctgtgcgacatcggggagagcagccccaacccgaccgtcgaggccggccgcaccctccgggtgctgaacctggtggagaactggctcaacaacaacacccagttctgcatcaaggtcctgaacccctacatgccctccgtgatcgagaagatggaggccctgcagcgcaagtacggcggggccctggtgcggaacccgctcagccgcaactccacgcacgagatgtactgggtcagcaacgcctccggcaacatcgtgagctccgtgaacatgatcagccggatgctgatcaaccgcttcaccatgcggcacaagaaggcgacctacgagcccgacgtcgacctggggtccggcacccgcaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctgctgaccaagccgtgggacatcatccccatggtgacccagatggccatgaccgacacgacccccttcgggcagcagcgcgtgttcaaggagaaggtcgacacccggacccaggagcccaaggagggcacgaagaagctcatgaagatcaccgccgagtggctgtggaaggagctgggcaagaagaagaccccgcgcatgtgcacccgggaggagttcacgcgcaaggtgcggagcaacgcggccctcggggccatcttcaccgacgagaacaagtggaagtccgcccgcgaggccgtcgaggacagcggcttctgggagctggtggacaaggagcggaacctgcacctcgaggggaagtgcgagacctgcgtgtacaacatgatgggcaagcgcgagaagaagctgggggagttcggcaaggcgaagggctcccgggccatctggtacatgtggctgggggcccgcttcctcgagttcgaggccctgggcttcctgaacgaggaccactggttcagccgggagaacagcctctccggggtcgagggcgaggggctgcacaagctgggctacatcctccgcgacgtgagcaagaaggagggcggggcgatgtacgccgacgacaccgccggctgggacacgcggatcaccctggaggacctgaagaacgaggagatggtgaccaaccacatggagggggagcacaagaagctcgccgaggccatcttcaagctgacctaccagaacaaggtcgtgcgcgtgcagcggcccacgccccgcggcaccgtcatggacatcatctcccggcgcgaccagcgggggagcggccaggtggtgacctacggcctgaacaccttcacgaacatggaggcgcagctcatccgccagatggagggggagggcgtcttcaagtccatccagcagctgaccgtgaccgaggagatcgccgtgaagaactggctggtccgcgtggggcgggagcgcctcagccggatggccatctccggcgacgactgcgtggtcaagcccctggacgaccgcttcgccagcgccctgaccgcgctcaacgacatgggcaaggtgcggaaggacatccagcagtgggagccgtcccgcgggtggaacgactggacccaggtgcccttctgcagccaccacttccacgagctgatcatgaaggacggccgggtcctggtggtgccctgccgcaaccaggacgagctcatcgggcgggcccgcatctcccagggcgccgggtggagcctgcgggagaccgcctgcctgggcaagtcctacgcccagatgtggagcctcatgtacttccaccgccgggacctgcgcctggcggccaacgccatctgctccgccgtccccagccactgggtgccgacctcccggaccacctggagcatccacgccacgcacgagtggatgaccaccgaggacatgctcaccgtgtggaaccgcgtctggatccaggagaacccctggatggaggacaagacgctggtggagagctgggaggagatcccctacctgggcaagcgggaggaccagtggtgcgggtccctcatcggcctgaccagccgcgcgacctgggccaagaacatccagaccgccatcaaccaggtgcggtccctgatcgggaacgaggagtacacggactacatgcccagcatgaagcgcttccgccgggaggaggaggaggccggcgtcctctggtga

SEQ ID NO: 9710 - RNA, 9876 nt, synthetic construct
  misc_feature 1..9876: note = derived and/or modified CDS sequence (opt1) from DENV-2__JN851130__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgctactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggccctgttcctcgaggagatgctgcgcacccgggtggggaccaagcacgcgatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgccctgctggccgcgttcaaggtgcggcccacgttcgccgccggcctcctgctgcgcaagctcacctccaaggagctgatgatgaccaccatcgggatcgtgctgctcagccagtccacgatccccgagaccatcctggagctgaccgacgccctcgccctgggcatgatggcgctgaagatcgtccggaacatggagaagtaccagctcgccgtgaccatcatggccatcctgtgcgtcccgaacgccgtgatcctgcagaacgcctggaaggtgagctgcacgaccctcgcggtcgtgtccgtgagccccctgctgctcacctccagccagcagaaggccgactggatccccctggccctgaccatcaaggggctcaaccccacggccatcttcctgaccaccctgtcccgcaccagcaagaagcggtcctggccgctcaacgaggcgatcatggccgtcggcatggtgagcatcctggcctccagcctgctcaagaacgacatccccatgacgggccccctggtggccgggggcctgctcaccgtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagacgctgaccatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacacgatgtggcacgtgacccgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacacgggcaccatcggggccgtgagcctggacttctcccccggcaccagcggctcccccatcgtggacaagaaggggaaggtcgtgggcctctacgggaacggcgtggtcacccggagcggcacgtacgtgtccgcgatcgcccagaccgagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggacgctgatcctggccccgacccgcgtcgtggccgccgagatggaggaggccctccgcggcctgcccatccggtaccagacccccgcgatccgcgccgagcacaccgggcgggagatcgtggacctgatgtgccacgccacgttcaccatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctccggaagaacggcaagaaggtgatccagctgagccgcaagacgttcgactccgagtacatcaagacccggaccaacgactgggacttcgtcgtgaccacggacatcagcgagatgggcgcgaacttcaaggccgagcgcgtgatcgacccccggcgctgcatgaagcccgtcatcctgaccgacggggaggagcgggtgatcctcgccggccccatgccggtgacccactccagcgccgcccagcgccgggggcgcgtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtggacgccatcgacggcgagtaccgcctgcgcggggaggcccgcaagacgttcgtggacctgatgcggcgcggcgacctccccgtctggctggcctaccgggtggcggccgaggggatcaactacgccgaccgccggtggtgcttcgacggcgtcaagaacaaccagatcctggaggagaacgtggaggtggagatctggaccaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccacgttcatgacccagaaggcccggaacgccctggacaacctcgcggtcctgcacaccgccgaggccgggggccgcgcctacaaccacgccctgagcgagctccccgagaccctggagacgctgctcctgctgaccctcctggcgaccgtgaccgggggcatcttcctgttcctcatgtccggcaaggggatcggcaagatgaccctggggatgtgctgcatcatcacggccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcaccgtggtcgccgccacgatggccaacgagatgggcttcctggagaagaccaagaaggacttcgggctgggcagcatcaccacccagcagccggagagcaacatcctcgacatcgacctgcgccccgcctccgcgtggacgctgtacgccgtggccaccaccttcatcacccccatgctccggcacagcatcgagaactccagcgtgaacgtctccctgacggccatcgccaaccaggcgaccgtgctgatgggcctcgggaagggctggcccctgagcaagatggacatcggggtgccgctgctcgccatcggctgctactcccaggtcaaccccatcaccctgaccgccgccctgctcctgctggtggcgcactacgccatcatcgggcccggcctccaggccaaggccacgcgcgaggcccagaagcgggcggccgccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcgcacgacctgggccctgtgcgaggccctgaccctcgcgaccgggcccatcagcacgctgtgggagggcaacccggggcgcttctggaacaccaccatcgccgtgtccatggccaacatcttccggggcagctacctggccggcgccgggctcctgttctccatcatgaagaacaccgcgaacacgcgccggggcaccgggaacaccggcgagaccctgggcgagaagtggaagaaccgcctcaacgccctgggcaagagcgagttccagatctacaagaagtccggcatccaggaggtcgaccggacgctggccaaggaggggatcaagcgcggcgagaccgaccaccacgccgtgagccgggggtccgcgaagctccgctggttcgtggagcggaacctggtcacccccgagggcaaggtggtggacctgggctgcgggcgcggcgggtggagctactactgcggcgggctcaagaacgtcaaggaggtgaagggcctgaccaagggcgggcccggccacgaggagcccatcccgatgtccacgtacgggtggaacctggtgcggctccagagcggcgtcgacgtgttcttcacgccgcccgagaagtgcgacaccctgctgtgcgacatcggggagtccagccccaacccgaccgtggaggccggccgcaccctccgggtcctgaacctggtggagaactggctcaacaacaacacgcagttctgcatcaaggtgctgaacccctacatgcccagcgtcatcgagaagatggaggccctgcagcgcaagtacggcggggccctggtgcggaacccgctctcccgcaacagcacccacgagatgtactgggtgtccaacgccagcggcaacatcgtctccagcgtgaacatgatctcccggatgctgatcaaccgcttcaccatgcggcacaagaaggcgacctacgagcccgacgtggacctggggagcggcacgcgcaacatcgggatcgagtccgagatccccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcggctgctgaccaagccgtgggacgtcatccccatggtgacccagatggccatgaccgacacgacccccttcgggcagcagcgcgtgttcaaggagaaggtcgacacccggacccaggagcccaaggagggcacgaagaagctcatgaagatcaccgccgagtggctgtggaaggagctgggcaagaagaagaccccgcgcatgtgcacccgggaggagttcacgcgcaaggtgcggtccaacgcggccctcggggccatcttcaccgacgagaacaagtggaagtccgcccgcgaggccgtcgaggactccggcttctgggagctggtggacaaggagcggaacctgcacctcgaggggaagtgcgagacctgcgtgtacaacatgatgggcaagcgcgagaagaagctgggggagttcggcaaggcgaagggcagccgggccatctggtacatgtggctgggggcccgcttcctcgagttcgaggccctgggcttcctgaacgaggaccactggttctcccgggagaacagcctcagcggggtcgagggcgaggggctgcacaagctgggctacatcctccgcgacgtgtccaagaaggagggcggggcgatgtacgccgacgacaccgccggctgggacacgcggatcaccctggaggacctgaagaacgaggagatggtgaccaaccacatggagggggagcacaagaagctcgccgaggccatcttcaagctgacctaccagaacaaggtcgtgcgcgtgcagcggcccacgccccgcggcaccgtcatggacatcatcagccggcgcgaccagcgggggtccggccaggtggtgacctacggcctgaacaccttcacgaacatggaggcgcagctcatccgccagatggagggggagggcgtcttcaagagcatccagcagctgaccgtgaccgaggagatcgccgtgaagaactggctggtccgcgtggggcgggagcgcctctcccggatggccatcagcggcgacgactgcgtggtcaagcccctggacgaccgcttcgcctccgccctgaccgcgctcaacgacatgggcaaggtgcggaaggacatccagcagtgggagccgagccgcgggtggaacgactggacccaggtgcccttctgctcccaccacttccacgagctgatcatgaaggacggccgggtcctggtggtgccctgccgcaaccaggacgagctcatcgggcgggcccgcatcagccagggcgccgggtggtccctgcgggagaccgcctgcctgggcaagagctacgcccagatgtggtccctcatgtacttccaccgccgggacctgcgcctggcggccaacgccatctgcagcgccgtcccctcccactgggtgccgaccagccggaccacctggtccatccacgccacgcacgagtggatgaccaccgaggacatgctcaccgtgtggaaccgcgtctggatccaggagaacccctggatggaggacaagacgcccgtggagagctgggaggagatcccctacctgggcaagcgggaggaccagtggtgcgggagcctgatcggcctcacctcccgcgcgacctgggccaagaacatccagaccgccatcaaccaggtgcggagcctgatcgggaacgaggagtacacggactacatgccgtccatgaagcgcttccgccgggaggaggaggaggccggcgtcctgtggtga

SEQ ID NO: 9711 - RNA, 9876 nt, synthetic construct
  misc_feature 1..9876: note = derived and/or modified CDS sequence (opt1) from DENV-2__JN851125__SS-prME
  source 1..9876: mol_type = other RNA
accgccgggatcatcatcatgatgatccccaccgtgatggccttccacctgaccacccggaacggggagccgcacatgatcgtcagccggcaggagaagggcaagagcctcctgttcaagaccgagaacggggtgaacatgtgcaccctgatggcgatggacctcggcgagctgtgcgaggacaccatcacctacaactgccccctgctcaagcagaacgagcccgaggacatcgactgctggtgcaacagcaccagcacctgggtgacgtacgggacctgcaccgccaccggcgagcaccgccgggagaagcgcagcgtcgccctggtgccccacgtgggcatggggctggagacgcggaccgagacctggatgagcagcgagggcgcctggaagcacgcccagcgcatcgagacctgggtcctccggcacccggggttcacggtgatggcggccatcctggcctacaccatcggcaccacctacttccagcgcgtgctgatcttcatcctcctgacggccgtcgcgccctccatgaccatgcggtgcatcgggatcagcaaccgcgacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcggaagtactgcatcgaggccaagctcaccaacacgaccaccgcgagccgctgcccgacccagggggagccctccctgaacgaggagcaggacaagcggttcgtctgcaagcacagcatggtggaccgcggctggggcaacgggtgcggcctgttcgggaagggcgggatcgtgacgtgcgccatgttcacgtgcaagaagaacatggagggcaaggtcgtgcagcccgagaacctcgagtacaccatcgtgatcacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccggaccggcctggacttcaacgagatggtcctcctgcagatggagaacaaggcctggctggtgcaccgccagtggttcctcgacctgcccctgccctggctcccgggcgcggacacccaggggtccaactggatccagaaggagaccctggtcacgttcaagaacccccacgccaagaagcaggacgtggtggtcctgggcagccaggagggggccatgcacaccgccctcaccggcgccaccgagatccagatgagctccgggaacctgctgttcacgggccacctcaagtgccggctgcgcatggacaagctgcagctcaagggcatgagctactccatgtgcaccgggaagttcaaggtggtgaaggagatcgcggagacccagcacggcaccatcgtcatccgggtgcagtacgagggggacggcagcccctgcaagatccccttcgagatcatggacctggagaagcgccacgtgctgggccggctcatcacggtcaacccgatcgtgaccgagaaggactcccccgtgaacatcgaggccgagccgcccttcggggacagctacatcatcatcggcgtcgagccggggcagctgaagctgtcctggttcaagaagggcagctccatcgggcagatgttcgagaccaccatgcgcggcgccaagcgcatggccatcctcggcgacacggcctgggacttcgggagcctgggcggggtgttcacctccatcggcaaggcgctgcaccaggtgttcggggccatctacggcgccgccttcagcggcgtctcctggaccatgaagatcctcatcggggtggtgatcacctggatcggcatgaacagccggtccacgagcctgtccgtcagcctggtgctggtgggggtcgtgaccctctacctgggcgtgatggtccaggcggactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccgcagcgtgacccggctggagaacctgatgtggaagcagatcacccccgagctcaaccacatcctgtccgagaacgaggtgaagatgaccatcatgacgggggacatcaagggcatcatgcaggccgggaagcgcagcctgcggccgcagcccaccgagctcaagtactcctggaaggcgtggggcaaggccaagatgctgagcaccgagctgcacaaccacaccttcctcatcgacggccccgagacggccgagtgcccgaacaccaaccgcgcctggaactccctggaggtcgaggactacgggttcggcgtgttcaccaccaacatctggctgaagctcaaggagcggcaggacgtgagctgcgactccaagctgatgagcgccgcgatcaaggacaaccgcgccgtccacgccgacatggggtactggatcgagtccgccctgaacgacacgtggaagatcgagaaggccagcttcatcgaggtgaagtcctgccactggcccaagagccacaccctctggtccaacggcgtgctggagagcgagatgatcatccccaagaacttcgcgggccccgtcagccagcacaactaccggccggggtaccacacccagaccgccggcccctggcacctggggcgcctcgagatggacttcgacttctgcgagggcaccacggtggtggtcaccgaggactgcgggaaccggggcccctccctgcgcaccaccacggccagcggcaagctgatcaccgagtggtgctgccggtcctgcaccctcccgcccctgcgctaccgcggggaggacggctgctggtacgggatggagatccgccccctgaaggagaaggaggagaacctcgtgaacagcctggtgaccgccggccacgggcagatcgacaacttctccctgggcgtcctcggcatggcgctgttcctggaggagatgctccggacgcgcgtggggaccaagcacgccatcctgctggtggccgtcagcttcgtgaccctcatcaccggcaacatgtccttccgggacctggggcgcgtgatggtcatggtgggcgccacgatgaccgacgacatcgggatgggcgtgacctacctggccctcctggcggccttcaaggtccgccccaccttcgccgccggcctgctcctgcggaagctgacgagcaaggagctcatgatgaccaccatcgggatcgtgctgctgtcccagagcaccatccccgagacgatcctcgagctgaccgacgccctggcgctcggcatgatggtcctgaaggtggtgcgcaacatggagaagtaccagctggccgtcaccatcatggccatcctctgcgtgcccaacgccgtgatcctgcagaacgcctggaaggtctcctgcaccacgctggcggtggtgagcgtcttccccctcctgctgacctccagccagcagaaggccgactggatccccctcgccctgaccatcaaggggctgaaccccaccgccatcttcctcacgaccctgtcccggaccagcaagaagcgctcctggccgctgaacgaggcgatcatggccgtgggcatggtgagcatcctcgcctccagcctgctgaagaacgacatccccatgaccggccccctcgtcgccgggggcctgctgacggtgtgctacgtgctcaccgggcggagcgccgacctggagctggagcgcgcggccgacgtccggtgggaggagcaggccgagatctccggcagctcccccatcctcagcatcaccatctccgaggacgggagcatgtccatcaagaacgaggaggaggagcagaccctgacgatcctgatccgcaccggcctcctggtgatcagcggcctgttcccggtgtccatccccatcaccgccgccgcgtggtacctctgggaggtcaagaagcagcgggccggggtgctgtgggacgtgccctccccgccgcccgtcggcaaggccgagctggaggacggggcctaccgcatcaagcagaagggcatcctcgggtactcccagatcggcgccggcgtgtacaaggaggggaccttccacaccatgtggcacgtgacgcggggcgcggtcctgatgcacaaggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggccgtgcagaccaagcccggcctcttcaagaccaacaccggcacgatcggggccgtgagcctggacttctcccccggcaccagcggctcccccatcgtcgacaagaaggggaaggtggtgggcctgtacgggaacggcgtcgtgacccgcagcggcacctacgtgtccgcgatcgcccagacggagaagtccatcgaggacaaccccgagatcgaggacgacatcttccggaagaagcgcctcaccatcatggacctgcaccccggggccggcaagaccaagcggtacctgcccgccatcgtccgcgaggcgatcaagcgggggctgcgcaccctcatcctggccccgacgcgggtggtggccgccgagatggaggaggccctgcgcggcctccccatccgctaccagacccccgcgatccgggccgagcacaccgggcgcgagatcgtcgacctgatgtgccacgccaccttcacgatgcggctgctcagccccatccgcgtgccgaactacaacctgatcatcatggacgaggcccacttcaccgaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctgcgcaagaacggcaagaaggtcatccagctcagccggaagaccttcgactccgagtacatcaagacgcgcaccaacgactgggacttcgtggtgaccaccgacatcagcgagatgggcgcgaacttcaaggccgagcgggtcatcgacccccgccggtgcatgaagcccgtgatcctgacggacggggaggagcgcgtgatcctggccggccccatgccggtcacccactccagcgccgcccagcggcgcgggcgggtgggccgcaaccccaagaacgagtccgaccagtacatctacatgggggagcccctcgagaacgacgaggactgcgcgcactggaaggaggccaagatgctgctggacaacatcaacacccccgagggcatcatcccgagcatgttcgagcccgagcgcgagaaggtcgacgccatcgacggcgagtaccggctccgcggggaggcccggaagaccttcgtggacctgatgcgccggggcgacctgcccgtgtggctcgcctaccgcgtcgcggccgaggggatcaactacgccgaccggcgctggtgcttcgacggcgtgaagaacaaccagatcctggaggagaacgtggaggtcgagatctggacgaaggagggggagcggaagaagctgaagccgcgctggctcgacgcccggatctactccgaccccctggccctgaaggagttcaaggagttcgcggccggccgcaagagcctcaccctgaacctgatcaccgagatgggccggctccccaccttcatgacgcagaaggcccgcaacgccctggacaacctggcggtgctccacaccgccgaggccgggggccgggcctacaaccacgccctgtccgagctgcccgagaccctcgagaccctgctgctcctgacgctgctcgcgaccgtgaccgggggcatcttcctgttcctgatgagcggcaaggggatcggcaagatgaccctcgggatgtgctgcatcatcaccgcctccatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccaccatggccaacgagatgggcttcctcgagaagacgaagaaggacttcgggctgggcagctccaccacccagcagcacgagagcaacatcctggacatcgacctccggccggcctccgcgtggaccctgtacgccgtggccacgaccttcatcacccccatgctgcgccacagcatcgagaactccagcgtcaacgtgtccctcaccgccatcgccaaccaggcgacggtgctgatgggcctggggaagggctggcccctcagcaagatggacatcggggtccccctgctggccatcggctgctactcccaggtgaacccgatcaccctcaccgccgccctgctgagcctcgtggcgcactacgccatcatcgggcccggcctgcaggccaaggccacccgggaggcccagaagcgcgcggccgccggcatcatgaagaaccccacggtcgacgggatcaccgtgatcgacctggaccccatcccgtacgaccccaagttcgagaagcagctcggccaggtgatgctgctggtcctctgcgtgacccaggtgctgatgatgcggaccacgtgggccctgtgcgaggccctcaccctggcgaccgggcccatctccaccctgtgggagggcaaccccgggcgcttctggaacacgaccatcgccgtcagcatggccaacatcttccgcggctcctacctcgccggcgccgggctgctgttcagcatcatgaagaacaccgcgaacacccggcgcggcacggggaacaccggcgagaccctcggcgagaagtggaagaaccggctgaacgccctggggaagtccgagttccagatctacaagaagtccggcatccaggaggtggaccgcaccctcgccaaggaggggatcaagcggggcgagacggaccaccacgccgtgtcccgcgggagcgcgaagctgcggtggttcgtcgagcgcaacctggtgaccccggagggcaaggtggtcgacctcggctgcgggcggggcgggtggtcctactactgcggcgggctgaagaacgtgaaggaggtgaagggcctgaccaagggcgggcccggccacgaggagcccatccccatgagcacctacgggtggaacctcgtccgcctgcagagcggcgtggacgtgttcttcacgccgcccgagaagtgcgacaccctgctctgcgacatcggggagtccagccccaaccccaccgtcgaggccggccggaccctgcgcgtgctgaacctcgtggagaactggctgaacaacaacacccagttctgcatcaaggtcctgaacccgtacatgccctccgtgatcgagaagatggaggccctccagcggaagtacggcggggccctggtgcgcaaccccctgagccggaactccacgcacgagatgtactgggtcagcaacgcctccggcaacatcgtgagctccgtgaacatgatcagccgcatgctgatcaaccggttcaccatgcgccacaagaaggcgacctacgagccggacgtcgacctcgggtccggcacccggaacatcgggatcgagagcgagacgcccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccgcctgctcaccaagccctgggacgtgatcccgatggtcacccagatggccatgaccgacacgacccccttcgggcagcagcgggtgttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtccgcagcaacgcggccctgggggccatcttcaccgacgagaacaagtggaagtccgcccgggaggccgtggaggacagcggcttctgggagctggtggacaaggagcgcaacctccacctggaggggaagtgcgagacctgcgtctacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgagaacagcctgtccggggtggagggcgaggggctgcacaagctcggctacatcctgcgggacgtgagcaagaaggagggcggggcgatgtacgccgacgacaccgccggctgggacacgcgcatcaccctggaggacctcaagaacgaggagatggtcaccaaccacatggagggggagcacaagaagctggccgaggccatcttcaagctgacctaccagaacaaggtggtgcgggtccagcgcccgacgccccggggcaccgtgatggacatcatctcccgccgggaccagcgcgggagcggccaggtggtcacctacggcctcaacaccttcacgaacatggaggcgcagctgatccggcagatggagggggagggcgtgttcaagtccatccagcagctgaccgccaccgaggagatcgccgtgaagaactggctcgtccgcgtggggcgcgagcggctgagccgcatggccatctccggcgacgactgcgtggtcaagcccctggacgaccggttcgccagcgcgctcaccgccctgaacgacatgggcaaggtgcgcaaggacatccagcagtgggagccctcccgggggtggaacgactggacccaggtgccgttctgcagccaccacttccacgagctgatcatgaaggacggccgcgtcctcgtggtgccctgccggaaccaggacgagctgatcgggcgcgcccggatctcccagggcgccgggtggagcctgcgcgagaccgcctgcctcggcaagtcctacgcgcagatgtggagcctgatgtacttccaccggcgcgacctgcggctcgccgccaacgccatctgctccgccgtccccagccactgggtgcccaccagccgcaccacctggtccatccacgcgacgcacgagtggatgaccaccgaggacatgctgaccgtgtggaaccgggtctggatccaggagaacccgtggatggaggacaagacgcccgtggagagctgggaggagatcccctacctgggcaagcgcgaggaccagtggtgcgggtccctcatcggcctgaccagccgggccacctgggccaagaacatccagaccgccatcaaccaggtgcgctccctgatcgggaacgaggagtacacggactacatgcccagcatgaagcggttccgccgcgaggaggaggaggcgggcgtcctctggtga

SEQ ID NO: 9712 - RNA, 9876 nt, synthetic construct
  misc_feature 1..9876: note = derived and/or modified CDS sequence (opt1) from DENV-2__JN851123__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacacgatcacctacaactgccccctgctcaagcagaacgagcccgaggacatcgactgctggtgcaacagcaccagcacctgggtgacgtacgggacctgcaccgccaccggcgagcaccgccgggagaagcgcagcgtcgccctggtgccccacgtgggcatggggctggagacgcggaccgagacctggatgtccagcgagggcgcctggaagcacgcccagcgcatcgagacctgggtcctccggcaccccgggttcacgatcatggcggccatcctggcctacaccatcggcaccacctacttccagcgcgtgctgatcttcatcctcctgacggccgtggcgccctccatgaccatgcggtgcatcgggatcagcaaccgcgacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcggaagtactgcatcgaggccaagctcaccaacacgaccaccgcgagccgctgcccgacccagggggagccctccctgaacgaggagcaggacaagcggttcgtgtgcaagcacagcatggtcgaccgcggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctggacttcaacgagatggtgctcctgcagatggagaacaaggcctggctggtgcaccgccagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccggctgcgcatggacaagctgcagctcaagggcatgagctactccatgtgcaccgggaagttcaaggtggtcaaggagatcgcggagacccagcacggcaccatcgtgatccgggtgcagtacgagggggacggcagcccctgcaagatccccttcgagatcatggacctggagaagcgccacgtcctgggccggctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcgcatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccggtccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccgcagcgtgacccggctggagaacctgatgtggaagcagatcacccccgagctcaaccacatcctgtccgagaacgagatcaagctgaccatcatgacgggggacatcaagggcatcatgcaggccgggaagcgcagcctccggccgcagcccaccgagctgaagtactcctggaaggcgtggggcaaggccaagatgctgagcaccgagctccacaaccacaccttcctgatcgacggccccgagacggccgagtgcccgaacaccaaccgcgcctggaactccctggaggtcgaggactacgggttcggcgtgttcaccaccaacatctggctcaagctgaaggagcggcaggacgtgttctgcgacagcaagctgatgtccgccgcgatcaaggacaaccgcgccgtccacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccggccggggtaccacacccagaccgccggcccctggcacctcgggcgcctggagatggacttcgacttctgcgagggcaccacggtggtggtcaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtgaccgccggccacgggcagatcgacaacttcagcctcggcgtcctgggcatggcgctgttcctcgaggagatgctgcggacgcgcgtggggaccaagcacgccatcctgctcgtggccgtctccttcgtgaccctgatcaccggcaacatgagcttccgggacctggggcgcgtgatggtcatggtgggcgccacgatgaccgacgacatcgggatgggcgtgacctacctcgccctgctggcggccttcaaggtccgccccaccttcgccgccggcctcctgctgcggaagctcacgtccaaggagctgatgatgaccaccatcgggatcgtgctgctcagccagtccaccatccccgagacgatcctggagctgaccgacgccctcgcgctgggcatgatggtgctgaagatcgtccgcaacatggagaagtaccagctcgccgtgaccatcatggccatcctgtgcgtcccgaacgccgtgatcctgcagaacgcctggaaggtgagctgcaccacgctcgcggtcgtgtccgtgagccccctgctgctcacctccagccagcagaaggccgactggatccccctggccctgaccatcaaggggctcaaccccaccgccatcttcctgacgaccctgtcccggaccagcaagaagcgctcctggccgctcaacgaggcgatcatggccgtcggcatggtgagcatcctggcctccagcctgctcaagaacgacatccccatgaccggccccctggtggccgggggcctgctcacggtctgctacgtgctgaccgggcggagcgccgacctggagctcgagcgcgcggccgacgtgcggtgggaggagcaggccgagatctccggcagctcccccatcctgagcatcaccatctccgaggacgggagcatgtccatcaagaacgaggaggaggagcagaccctgacgatcctcatccgcaccggcctgctggtcatcagcggcctcttcccggtgtccatccccatcaccgccgccgcgtggtacctgtgggaggtgaagaagcagcgggccggggtcctgtgggacgtgcccagcccgccgcccgtgggcaaggccgagctcgaggacggggcctaccgcatcaagcagaagggcatcctggggtactcccagatcggcgccggcgtctacaaggaggggaccttccacaccatgtggcacgtgacgcggggcgcggtgctgatgcacaaggggaagcgcatcgagcccagctgggccgacgtcaagaaggacctcatctcctacggcgggggctggaagctggagggcgagtggaaggagggggaggaggtccaggtgctggccctcgagcccggcaagaacccccgggccgtccagaccaagcccgggctgttcaagaccaacaccggcacgatcggggccgtgagcctggacttctcccccggcaccagcggctcccccatcgtggacaagaaggggaaggtcgtgggcctctacgggaacggcgtggtcacccgcagcggcacctacgtgtccgcgatcgcccagacggagaagtccatcgaggacaaccccgagatcgaggacgacatcttccggaagaagcgcctgaccatcatggacctgcaccccggggccggcaagaccaagcggtacctgcccgccatcgtgcgcgaggcgatcaagcgggggctccgcaccctgatcctggccccgacgcgggtcgtggccgccgagatggaggaggccctccgcggcctgcccatccgctaccagacccccgcgatccgggccgagcacaccgggcgcgagatcgtggacctgatgtgccacgccaccttcacgatgcggctcctgagccccatccgcgtcccgaactacaacctgatcatcatggacgaggcccacttcaccgaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtgaccgacttcaagggcaagaccgtctggttcgtgccgtccatcaaggccgggaacgacatcgccgcctgcctccgcaagaacggcaagaaggtgatccagctgagccggaagaccttcgactccgagtacatcaagacgcgcaccaacgactgggacttcgtcgtgaccaccgacatcagcgagatgggcgcgaacttcaaggccgagcgggtgatcgacccccgccggtgcatgaagcccgtcatcctgacggacggggaggagcgcgtgatcctcgccggccccatgccggtgacccactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtcaagaacaaccagatcctggaggagaacgtggaggtggagatctggacgaaggagggggagcggaagaagctcaagccgcgctggctggacgcccggatctacagcgaccccctggccctcaaggagttcaaggagttcgcggccggccgcaagtccctgaccctgaacctcatcaccgagatgggccggctgcccaccttcatgacgcagaaggcccgcaacgccctggacaacctcgcggtcctgcacaccgccgaggccgggggccgggcctacaaccacgccctgagcgagctccccgagaccctggagaccctgctcctgctgacgctcctggcgaccgtgaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgcgatcctcaccgtggtcgccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtggccacgaccttcatcacccccatgctccgccacagcatcgagaactccagcgtgaacgtctccctgaccgccatcgccaaccaggcgacggtgctgatgggcctcgggaagggctggcccctgagcaagatggacatcggggtgccgctgctcgccatcggctgctactcccaggtcaaccccatcaccctgaccgccgccctgctcctgctggtggcgcactacgccatcatcgggcccggcctccaggccaaggccacccgggaggcccagaagcgcgcggccgccggcatcatgaagaaccccacggtggacgggatcaccgtcatcgacctggacccgatcccctacgaccccaagttcgagaagcagctgggccaggtgatgctcctggtgctgtgcgtcacccaggtgctcatgatgcggaccacgtgggccctgtgcgaggccctgaccctcgcgaccgggcccatcagcaccctgtgggagggcaacccggggcgcttctggaacacgaccatcgccgtgtccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctgggcaagagcgagttccagatctacaagaagtccggcatccaggaggtcgaccgcaccctggccaaggaggggatcaagcggggcgagacggaccaccacgccgtgagccgcgggtccgcgaagctccggtggttcatcgagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacgcacgagatgtactgggtgtccaacgccagcggcaacatcgtgtccagcgtcaacatgatctcccgcatgctgatcaaccggttcaccatgcgccacaagaaggcgacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctgaccaagccgtgggacgtgatccccatggtcacccagatggccatgaccgacacgacccccttcgggcagcagcgggtgttcaaggagaaggtggacacccgcacccaggagcccaaggagggcacgaagaagctcatgaagatcaccgccgagtggctgtggaaggagctgggcaagaagaagaccccgcggatgtgcacccgcgaggagttcacgcggaaggtccgctccaacgcggccctcggggccatcttcaccgacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacgcgcatcaccctggaggacctgaagaacgaggagatggtgaccaaccacatggagggggagcacaagaagctcgccgaggccatcttccggctgacctaccagaacaaggtggtccgcgtgcagcggcccacgccccgcggcaccgtgatggacatcatcagccggcgcgaccagcgggggtccggccaggtcgtgacctacggcctgaacaccttcacgaacatggaggcgcagctcatccgccagatggagggggagggcgtgttcaagagcatccagcacctgaccgtcaccgaggagatcgccgtgaagaactggctggtgcgcgtcgggcgggagcgcctctcccggatggccatcagcggcgacgactgcgtggtgaagcccctggacgaccgcttcgcctccgccctgaccgcgctcaacgacatgggcaaggtccggaaggacatccagcagtgggagccgagccgcgggtggaacgactggacccaggtgcccttctgctcccaccacttccacgagctgatcatgaaggacggccgggtgctggtcgtgccctgccgcaaccaggacgagctcatcgggcgggcccgcatcagccagggcgccgggtggtccctgcgggagaccgcctgcctgggcaagagctacgcccagatgtggtccctcatgtacttccaccgccgggacctgcgcctggcggccaacgccatctgcagcgccgtgccctcccactgggtcccgaccagccggaccacctggtccatccacgccacgcacgagtggatgaccaccgaggacatgctcaccgtgtggaaccgcgtgtggatccaggagaacccctggatggaggacaagacgcccatcgagagctgggaggagatcccctacctgggcaagcgggaggaccagtggtgcgggagcctgatcggcctcacctcccgcgcgacctgggccaagaacatccagaccgccatcaaccaggtccggagcctgatcgggaacgaggagtacacggactacatgccgtccatgaagcgcttccgccgggaggaggaggaggccggcgtgctgtggtga

SEQ ID NO: 9713 - RNA, 9876 nt, synthetic construct
  misc_feature 1..9876: note = derived and/or modified CDS sequence (opt1) from DENV-2__JN851118__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaaggccgggaacgacatcgccgcctgcctccggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctgacggacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtcgccacgaccttcatcacccccatgctccgccacagcatcgagaactccagcgtgaacgtgtccctgaccgccatcgccaaccaggcgacggtcctgatgggcctcgggaagggctggcccctgagcaagatggacatcggggtgccgctgctcgccatcggctgctactcccaggtgaaccccatcaccctgaccgccgccctgctcctgctggtcgcgcactacgccatcatcgggcccggcctccaggccaaggccacccgggaggcccagaagcgcgcggccgccggcatcatgaagaaccccacggtggacgggatgaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgcgaccgggcccatcagcaccctgtgggagggcaacccggggcgcttctggaacacgaccatcgccgtgtccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctgggcaagagcgagttccagatctacaagaagtccggcatccaggaggtggaccgcaccctggccaaggaggggatcaagcggggcgagacggaccaccacgccgtcagccgcgggtccgcgaagctccggtggttcgtggagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacgcacgagatgtactgggtgtccaacgccagcggcaacatcgtgtccagcgtcaacatgatctcccgcatgctgatcaaccggttcaccatgcgccacaagaaggcgacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctgaccaagccgtgggacgtgatccccatggtcacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgctccaacgcggccctcggggccatcttcaccgacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtggtccgggtgcagcgccccacgccccggggcaccgtgatggacatcatcagccgccgggaccagcgcgggtccggccaggtcgtgacctacggcctgaacaccttcacgaacatggaggcgcagctcatccggcagatggagggggagggcgtgttcaagagcatccagcagctgaccgtcaaggaggagatcgccgtgaagaactggctgatccgcgtggggcgcgagcggctctcccgcatggccatcagcggcgacgactgcgtcgtgaagcccctggacgaccggttcgcctccgccctgaccgcgctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagacggcctgcctgggcaagagctacgcccagatgtggtccctcatgtacttccaccggcgcgacctgcggctggcggccaacgccatctgcagcgccgtgccctcccactggatcccgaccagccgcaccacctggtccatccacgccacccacgagtggatgacgaccgaggacatgctcaccgtgtggaaccgggtctggatccaggagaacccctggatggaggacaagacccccgtggagagctgggaggagatcccctacctgggcaagcgcgaggaccagtggtgcgggagcctgatcggcctcacgtcccgggcgacctgggccaagaacatccagaccgccatcaaccaggtgcgcagcctgatcgggaacgaggagtacaccgactacatgccgtccatgaagcggttccgccgcgaggaggaggaggccggcgtcctgtggtga

SEQ ID NO: 9714 - RNA, 9876 nt, synthetic construct
  misc_feature 1..9876: note = derived and/or modified CDS sequence (opt1) from DENV-2__JN851124__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctcaagcagaacgagcccgaggacatcgactgctggtgcaacagcacctccacctgggtgacctacgggacctgcaccgccaccggcgagcaccgccgggagaagcgcagcgtcgccctggtgccccacgtgggcatggggctggagacgcggaccgagacctggatgtccagcgagggcgcctggaagcacgcccagcgcatcgagacctgggtcatgcggcacccggggttcacggtgatggcggccatcctcgcctacaccatcggcaccacctacttccagcgcgtgctgatcttcatcctgctcacggccgtcgcgccctccatgaccatgcggtgcatcgggatcagcaaccgcgacttcgtggagggcgtgtccggcgggagctgggtcgacatcgtgctggagcacggctcctgcgtgaccaccatggccaagaacaagcccacgctggacttcgagctcatcaagaccgaggccaagcaccccgccaccctgcggaagtactgcatcgaggccaagctgaccaacacgaccaccgcgagccgctgcccgacccagggggagccctccctcaacgaggagcaggacaagcggttcgtctgcaagcacagcatggtggaccgcggctggggcaacgggtgcggcctgttcgggaagggcgggatcgtgacgtgcgccatgttcacgtgcaagaagaacatggagggcaaggtcgtgcagcccgagaacctggagtacaccatcgtgatcacgccccactccggcgaggagaacgccgtcgggaacgacacgggcaagcacgggaaggagatcaaggtgaccccgcagagctccatcaccgaggccgagctcaccggctacgggaccgtgacgatggagtgcagcccccggaccggcctggacttcaacgagatggtcctgctccagatggagaacaaggcctggctggtgcaccgccagtggttcctggacctccccctgccctggctgccgggcgcggacacccaggggtccaactggatccagaaggagaccctcgtcacgttcaagaacccccacgccaagaagcaggacgtggtggtcctgggcagccaggagggggccatgcacaccgccctgaccggcgccaccgagatccagatgagctccgggaacctcctgttcacgggccacctgaagtgccggctccgcatggacaagctgcagctgaagggcatgagctactccatgtgcaccgggaagttcaaggtggtgaaggagatcgcggagacccagcacggcaccatcgtcatccgggtgcagtacgagggggacggcagcccctgcaagatccccttcgagatcatggacctcgagaagcgccacgtgctgggccggctgatcacggtcaacccgatcgtgaccgagaaggactcccccgtgaacatcgaggccgagccgcccttcggggacagctacatcatcatcggcgtcgagccggggcagctcaagctgtcctggttcaagaagggcagctccatcgggcagatgttcgagaccaccatgcgcggcgccaagcgcatggccatcctgggcgacacggcctgggacttcgggagcctcggcggggtgttcacctccatcggcaaggcgctgcaccaggtgttcggggccatctacggcgccgccttcagcggcgtctcctggaccatgaagatcctgatcggggtggtgatcacctggatcggcatgaacagccggtccacgagcctctccgtcagcctggtgctggtgggggtcgtgaccctgtacctcggcgtgatggtccaggcggactccgggtgcgtggtgagctggaagaacaaggagctgaagtgcggcagcggcatcttcatcaccgacaacgtccacacctggacggagcagtacaagttccagcccgagtcccccagcaagctggcctccgccatccagaaggcccacgaggaggggatctgcggcatccgcagcgtgacccggctcgagaacctgatgtggaagcagatcacccccgagctgaaccacatcctctccgagaacgaggtgaagatgaccatcatgacgggggacatcaagggcatcatgcaggccgggaagcgcagcctgcggccgcagcccaccgagctgaagtactcctggaaggcgtggggcaaggccaagatgctcagcaccgagctgcacaaccacaccttcctgatcgacggccccgagacggccgagtgcccgaacaccaaccgcgcctggaactccctcgaggtcgaggactacgggttcggcgtgttcaccaccaacatctggctgaagctgaaggagcggcaggacgtgagctgcgactccaagctcatgagcgccgcgatcaaggacaaccgcgccgtccacgccgacatggggtactggatcgagtccgccctgaacgacacgtggaagatcgagaaggccagcttcatcgaggtgaagtcctgccactggcccaagagccacaccctgtggtccaacggcgtgctcgagagcgagatgatcatccccaagaacttcgcgggccccgtcagccagcacaactaccggccggggtaccacacccagaccgccggcccctggcacctggggcgcctggagatggacttcgacttctgcgagggcaccacggtggtggtcaccgaggactgcgggaaccggggcccctccctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtgaccgccggccacgggcagatcgacaacttctccctgggcgtcctgggcatggccctcttcctggaggagatgctgcggacgcgcgtggggaccaagcacgccatcctcctggtggccgtcagcttcgtgaccctgatcaccggcaacatgtccttccgggacctcgggcgcgtgatggtcatggtgggcgccacgatgaccgacgacatcgggatgggcgtgacctacctggccctgctcgcggccttcaaggtccgccccaccttcgccgccggcctgctgctccggaagctgacgagcaaggagctgatgatgaccaccatcgggatcgtgctcctgtcccagagcaccatccccgagacgatcctggagctcaccgacgccctggcgctgggcatgatggtcctcaaggtggtgcgcaacatggagaagtaccagctggccgtcaccatcatggccatcctgtgcgtgccgaacgccgtgatcctccagaacgcctggaaggtctcctgcaccacgctggcggtggtgagcgtcagccccctgctcctgaccagctcccagcagaaggccgactggatccccctggccctcaccatcaaggggctgaaccccaccgccatcttcctgacgaccctcagccggacctccaagaagcgcagctggccgctgaacgaggcgatcatggccgtgggcatggtgtccatcctggccagcagcctcctgaagaacgacatccccatgaccggccccctggtcgccgggggcctcctgacggtgtgctacgtgctgaccgggcggtccgccgacctcgagctggagcgcgcggccgacgtccggtgggaggagcaggccgagatcagcggctccagccccatcctgtccatcaccatcagcgaggacgggtccatgagcatcaagaacgaggaggaggagcagaccctcacgatcctgatccgcaccggcctgctcgtgatctccggcctgttcccggtgagcatccccatcaccgccgccgcgtggtacctgtgggaggtcaagaagcagcgggccggggtgctctgggacgtgcccagcccgccgcccgtcggcaaggccgagctggaggacggggcctaccgcatcaagcagaagggcatcctggggtacagccagatcggcgccggcgtgtacaaggaggggaccttccacaccatgtggcacgtgacgcggggcgcggtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggccgtgcagaccaagcccgggctgttcaagaccaacaccggcacgatcggggccgtgtccctcgacttcagccccggcacctccggcagccccatcgtcgacaagaaggggaaggtggtgggcctgtacgggaacggcgtcgtgacccgctccggcacctacgtgagcgcgatcgcccagacggagaagtccatcgaggacaaccccgagatcgaggacgacatcttccggaagaagcgcctgaccatcatggacctccaccccggggccggcaagaccaagcggtacctgcccgccatcgtccgcgaggcgatcaagcgggggctgcgcaccctgatcctcgccccgacgcgggtggtggccgccgagatggaggaggccctgcgcggcctgcccatccgctaccagacccccgcgatccgggccgagcacaccgggcgcgagatcgtcgacctcatgtgccacgccaccttcacgatgcggctgctgtcccccatccgcgtgccgaactacaacctcatcatcatggacgaggcccacttcaccgaccccgccagcatcgcggcccggggctacatctccacccgcgtggagatgggcgaggccgccgggatcttcatgaccgccacgccgcccggcagccgggacccgttcccccagtccaacgcgcccatcatggacgaggagcgcgagatccccgagcggagctggaactccgggcacgagtgggtcaccgacttcaagggcaagaccgtgtggttcgtgccgagcatcaaggccgggaacgacatcgccgcctgcctgcgcaagaacggcaagaaggtcatccagctgtcccggaagaccttcgacagcgagtacatcaagacgcgcaccaacgactgggacttcgtggtgaccaccgacatctccgagatgggcgcgaacttcaaggccgagcgggtcatcgacccccgccggtgcatgaagcccgtgatcctcacggacggggaggagcgcgtgatcctggccggccccatgccggtcacccacagctccgccgcccagcggcgcgggcgggtgggccgcaaccccaagaacgagagcgaccagtacatctacatgggggagcccctggagaacgacgaggactgcgcgcactggaaggaggccaagatgctcctggacaacatcaacacccccgagggcatcatcccgtccatgttcgagcccgagcgcgagaaggtcgacgccatcgacggcgagtaccggctgcgcggggaggcccggaagaccttcgtggacctcatgcgccggggcgacctgcccgtgtggctggcctaccgcgtcgcggccgaggggatcaactacgccgaccggcgctggtgcttcgacggcgtgaagaacaaccagatcctcgaggagaacgtggaggtcgagatctggacgaaggagggggagcggaagaagctgaagccgcgctggctggacgcccggatctacagcgaccccctcgccctgaaggagttcaaggagttcgcggccggccgcaagtccctgaccctcaacctgatcaccgagatgggccggctgcccaccttcatgacgcagaaggcccgcaacgccctcgacaacctggcggtgctgcacaccgccgaggccgggggccgggcctacaaccacgccctcagcgagctgcccgagaccctggagaccctcctgctgctcacgctgctggcgaccgtgaccgggggcatcttcctcttcctgatgtccggcaaggggatcggcaagatgaccctggggatgtgctgcatcatcaccgccagcatcctcctgtggtacgcccagatccagccgcactggatcgccgccagcatcatcctggagttcttcctcatcgtcctgctgatccccgagcccgagaagcagcgcacgccccaggacaaccagctcacctacgtggtgatcgcgatcctgaccgtcgtggccgccaccatggccaacgagatgggcttcctggagaagacgaagaaggacttcgggctcggctccagcaccacccagcagcacgagtccaacatcctggacatcgacctgcggccggccagcgcgtggaccctctacgccgtggccacgaccttcatcacccccatgctgcgccactccatcgagaacagctccgtcaacgtgagcctgaccgccatcgccaaccaggcgacggtgctcatgggcctggggaagggctggcccctgtccaagatggacatcggggtccccctcctggccatcggctgctacagccaggtgaacccgatcaccctgaccgccgccctcctgtccctggtggcgcactacgccatcatcgggcccggcctccaggccaaggccacccgggaggcccagaagcgcgcggccgccggcatcatgaagaaccccacggtcgacgggatcaccgtgatcgacctggaccccatcccgtacgaccccaagttcgagaagcagctgggccaggtgatgctcctggtcctgtgcgtgacccaggtgctcatgatgcggaccacgtgggccctgtgcgaggccctgaccctcgcgaccgggcccatcagcaccctgtgggagggcaaccccgggcgcttctggaacacgaccatcgccgtctccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctggggaagtccgagttccagatctacaagaagtccggcatccaggaggtggaccgcaccctggccaaggaggggatcaagcggggcgagacggaccaccacgccgtgagccgcgggtccgcgaagctccggtggttcgtcgagcgcaacctggtgaccccggagggcaaggtggtcgacctgggctgcgggcggggcgggtggagctactactgcggcgggctcaagaacgtgaaggaggtgaagggcctgaccaagggcgggcccggccacgaggagcccatccccatgagcacctacgggtggaacctggtccgcctccagtccggcgtggacgtgttcttcacgccgcccgagaagtgcgacaccctgctgtgcgacatcggggagagctcccccaaccccaccgtcgaggccggccggaccctccgcgtgctgaacctggtggagaactggctcaacaacaacacccagttctgcatcaaggtcctgaacccgtacatgcccagcgtgatcgagaagatggaggccctgcagcggaagtacggcggggccctcgtgcgcaaccccctgtcccggaacagcacgcacgagatgtactgggtctccaacgccagcggcaacatcgtgtccagcgtgaacatgatctcccgcatgctgatcaaccggttcaccatgcgccacaagaaggtcacctacgagccggacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcgtaccacggctcctacgagaccaagcagacggggagcgcctccagcatggtgaacggcgtcgtgcgcctgctgaccaagccctgggacgtcatcccgatggtgacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagacgccccggatgtgcacccgcgaggagttcacgcggaaggtgcgctccaacgccgcgctcggggccatcttcaccgacgagaacaagtggaagtccgcccgggaggccgtggaggacagcggcttctgggagctggtcgacaaggagcgcaacctgcacctcgaggggaagtgcgagacctgcgtgtacaacatgatgggcaagcgggagaagaagctgggggagttcggcaaggccaagggctcccgcgcgatctggtacatgtggctgggggcccggttcctcgagttcgaggccctgggcttcctgaacgaggaccactggttcagccgcgagaactccctcagcggggtggagggcgaggggctgcacaagctgggctacatcctccgggacgtctccaagaaggagggcggggccatgtacgcggacgacaccgccggctgggacacgcgcatcaccctggaggacctgaagaacgaggagatggtgaccaaccacatggagggggagcacaagaagctcgccgaggccatcttcaagctgacctaccagaacaaggtggtccgggtgcagcgcccgacgccccggggcaccgtgatggacatcatcagccgccgggaccagcgcgggtccggccaggtcgtgacctacggcctgaacaccttcacgaacatggaggcccagctcatccggcagatggagggggagggcgtgttcaagagcatccagcagctgaccgcgaccgaggagatcgccgtcaagaactggctggtgcgcgtggggcgcgagcggctctcccgcatggccatcagcggcgacgactgcgtcgtgaagcccctggacgaccggttcgcctccgccctgaccgcgctcaacgacatgggcaaggtgcgcaaggacatccagcagtgggagcccagccgggggtggaacgactggacgcaggtcccgttctgctcccaccacttccacgagctgatcatgaaggacggccgcgtgctggtggtcccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtgcccagccactgggtgcccacctcccgcaccacctggagcatccacgccacgcacgagtggatgaccaccgaggacatgctcaccgtctggaaccgggtgtggatccaggagaacccgtggatggaggacaagacgcccgtggagtcctgggaggagatcccctacctgggcaagcgcgaggaccagtggtgcgggagcctgatcggcctcacctcccgggcgacctgggccaagaacatccagaccgccatcaaccaggtccgcagcctgatcgggaacgaggagtacacggactacatgccctccatgaagcggttccgccgcgaggaggaggaggccggcgtgctgtggtga

SEQ ID NO: 9715 - RNA, 9876 nt, synthetic construct
  misc_feature 1..9876: note = derived and/or modified CDS sequence (opt1) from DENV-2__JN851114__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacgtacgggacctgcaccgccaccggcgagcaccggcgggagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtggagaaggccgagctcgaggacggcgcctaccggatcaagcagaaggggatcctgggctactcccagatcggggccggcgtgtacaaggagggcaccttccacaccatgtggcacgtcacgcgcggggcggtgctgatgcacaagggcaagcggatcgagcccagctgggccgacgtgaagaaggacctcatctcctacgggggcgggtggaagctggagggcgagtggaaggagggcgaggaggtccaggtgctggccctcgagcccgggaagaacccccgcgccgtgcagaccaagcccggcctgttcaagaccaacaccgggacgatcggcgccgtcagcctggacttctcccccgggaccagcggctcccccatcgtggacaagaagggcaaggtggtcgggctctacggcaacggggtggtgacccggagcggcacctacgtctccgcgatcgcccagacggagaagtccatcgaggacaaccccgagatcgaggacgacatcttccgcaagaagcggctgaccatcatggacctgcaccccggcgccgggaagaccaagcgctacctgcccgccatcgtgcgggaggcgatcaagcgcggcctccggaccctgatcctggccccgacgcgcgtggtcgccgccgagatggaggaggccctccgcgggctgcccatccggtaccagacccccgcgatccgcgccgagcacaccggccgggagatcgtggacctgatgtgccacgccaccttcacgatgcgcctcctgagccccatccgggtgccgaactacaacctgatcatcatggacgaggcccacttcaccgaccccgcctccatcgcggcccgcgggtacatcagcacccgggtcgagatgggcgaggccgccggcatcttcatgaccgccacgccgcccgggtcccgcgacccgttcccccagagcaacgcgcccatcatggacgaggagcgggagatccccgagcgctcctggaacagcggccacgagtgggtgaccgacttcaaggggaagaccgtgtggttcgtcccgtccatcaaggccggcaacgacatcgccgcctgcctccggaagaacgggaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctgacggacggcgaggagcgggtcatcctcgccgggcccatgccggtgacccactccagcgccgcccagcgccggggccgcgtggggcgcaaccccaagaacgagaacgaccagtacatctacatgggcgagcccctggagaacgacgaggactgcgcgcactggaaggaggccaagatgctgctcgacaacatcaacacccccgaggggatcatcccgtccatgttcgagcccgagcgggagaaggtcgacgccatcgacggcgagtaccgcctgcggggcgaggcccgcaagaccttcgtggacctgatgcggcgcggggacctccccgtctggctggcctaccgggtggcggccgagggcatcaactacgccgaccgccggtggtgcttcgacggggtgaagaacaaccagatcctggaggagaacgtcgaggtggagatctggacgaaggagggcgagcgcaagaagctcaagccgcggtggctggacgcccgcatctacagcgaccccctggccctcaaggagttcaaggagttcgcggccgggcggaagtccctgaccctgaacctcatcaccgagatgggccgcctgcccaccttcatgacgcagaaggccaagaacgccctggacaacctcgcggtgctgcacaccgccgaggccggcgggcgggcctacaaccacgccctgagcgagctccccgagaccctggagaccctgctcctgctgacgctcctggcgaccgtcaccggcgggatcttcctgttcctcatgtccggcaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcaccgtggtggccgccaccatggccaacgagatggggttcctggagaagacgaagaaggacttcggcctggggagcatcaccacccagcagccggagagcaacatcctcgacatcgacctgcggcccgcctccgcgtggaccctgtacgccgtcgccacgaccttcatcacccccatgctccgccacagcatcgagaactccagcgtgaacgtgtccctgaccgccatcgccaaccaggcgacggtcctgatgggcctcggcaaggggtggcccctgagcaagatggacatcggcgtgccgctgctcgccatcgggtgctactcccaggtgaaccccatcaccctgaccgccgccctgctcctgctggtcgcgcactacgccatcatcggccccgggctccaggccaaggccacccgggaggcccagaagcgcgcggccgccggcatcatgaagaaccccacggtggacggcatgaccgtgatcgacctggacccgatcccctacgaccccaagttcgagaagcagctggggcaggtcatgctcctggtgctgtgcgtgacccaggtcctcatgatgcggaccacgtgggccctgtgcgaggccctgaccctcgcgaccggccccatcagcaccctgtgggaggggaacccgggccgcttctggaacacgaccatcgccgtgtccatggccaacatcttccgcgggagctacctggccggcgccggcctcctgttctccatcatgaagaacaccgcgaacacccggcgcgggacgggcaacaccggggagaccctgggcgagaagtggaagaaccggctcaacgccctgggcaagagcgagttccagatctacaagaagtccgggatccaggaggtggaccgcaccctggccaaggagggcatcaagcgcggggagacggaccaccacgccgtcagccgcggctccgcgaagctccggtggttcgtggagcgcaacctggtgacccccgaggggaaggtcgtggacctgggctgcggccgcggcgggtggagctactactgcggcgggctcaagaacgtgaaggaggtcaaggggctgaccaagggcgggcccgggcacgaggagcccatcccgatgtccacctacggctggaacctggtgcgcctccagagcggggtggacgtcttcttcacgccgcccgagaagtgcgacaccctgctgtgcgacatcggcgagtccagccccaacccgaccgtggaggccgggcggaccctccgcgtgctgaacctggtcgagaactggctcaacaacaacacccagttctgcatcaaggtgctgaacccctacatgcccagcgtgatcgagaagatggaggccctgcagcggaagtacggcggcgccctggtccgcaacccgctctcccggaacagcacgcacgagatgtactgggtgtccaacgccagcgggaacatcgtgtccagcgtcaacatgatctcccgcatgctgatcaaccggttcaccatgcgccacaagaaggcgacctacgagcccgacgtggacctgggcagcgggacccggaacatcggcatcgagtccgagacgcccaacctcgacatcatcgggaagcgcatcgagaagatcaagcaggagcacgagaccagctggcactacgaccaggaccacccctacaagacctgggcctaccacggctcctacgagaccaagcagacgggcagcgcctccagcatggtgaacggggtcgtgcgcctgctgaccaagccgtgggacgtgatccccatggtcacccagatggccatgaccgacacgacccccttcggccagcagcgggtgttcaaggagaaggtcgacacccgcacccaggagcccaaggaggggacgaagaagctcatgaagatcaccgccgagtggctgtggaaggagctgggcaagaagaagaccccgcggatgtgcacccgcgaggagttcacgcggaaggtgcgctccaacgcggccctcggcgccatcttcaccgacgagaacaagtggaagtccgcccgggaggccgtggaggactccgggttctgggagctggtcgacaaggagcgcaacctgcacctcgagggcaagtgcgagacctgcgtgtacaacatgatggggaagcgggagaagaagctgggcgagttcgggaaggcgaagggcagccgcgccatctggtacatgtggctgggcgcccggttcctcgagttcgaggccctggggttcctgaacgaggaccactggttctcccgcgagaacagcctcagcggcgtggagggggagggcctgcacaagctggggtacatcctccgggacgtctccaagaaggagggcggcgcgatgtacgccgacgacaccgccgggtgggacacgcgcatcaccctggaggacctgaagaacgaggagatggtgaccaaccacatggagggcgagcacaagaagctcgccgaggccatcttcaagctgacctaccagaacaaggtggtccgggtgcagcgccccacgccccgggggaccgtgatggacatcatcagccgccgggaccagcgcggctccgggcaggtcgtgacctacggcctgaacaccttcacgaacatggaggcgcagctcatccggcagatggagggcgagggggtgttcaagagcatccagcagctgaccgtcaaggaggagatcgccgtgaagaactggctgatccgcgtgggccgcgagcggctctcccgcatggccatcagcggggacgactgcgtcgtgaagcccctggacgaccggttcgcctccgccctgaccgcgctcaacgacatgggcaaggtgcgcaaggacatccagcagtgggagccgagccggggctggaacgactggacccaggtccccttctgctcccaccacttccacgagctgatcatgaaggacgggcgcgtgctggtggtcccctgccggaaccaggacgagctcatcggccgcgcccggatcagccagggggccggctggtccctgcgcgagacggcctgcctgggcaagagctacgcccagatgtggtccctcatgtacttccaccggcgcgacctgcggctggcggccaacgccatctgcagcgccgtgccctcccactgggtgccgaccagccgcaccacctggtccatccacgccacccacgagtggatgacgaccgaggacatgctcaccgtctggaaccgggtgtggatccaggagaacccctggatggaggacaagacccccgtggagagctgggaggagatcccctacctgggcaagcgcgaggaccagtggtgcggcagcctgatcgggctcacgtcccgggcgacctgggccaagaacatccagaccgccatcaaccaggtccgcagcctgatcggcaacgaggagtacaccgactacatgccgtccatgaagcggttccgccgcgaggaggaggaggccggggtgctgtggtga

SEQ ID NO: 9716 - RNA, 9876 nt, synthetic construct
  misc_feature 1..9876: note = derived and/or modified CDS sequence (opt1) from DENV-2__JN851126__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggggagctgtgcgaggacaccatcacctacaactgccccctgctcaagcagaacgagcccgaggacatcgactgctggtgcaacagcaccagcacctgggtgacctacgggacctgcaccgccaccggcgagcaccgccgggagaagcgcagcgtcgccctggtgccccacgtgggcatggggctggagacccggaccgagacctggatgtccagcgagggcgcctggaagcacgcccagcgcatcgagacctgggtcctccggcaccccgggttcacgatcatggcggccatcctggcctacaccatcggcaccacctacttccagcgcgtgctgatcttcatcctcctgacggccgtggcgccctccatgaccatgcggtgcatcgggatcagcaaccgcgacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcggaagtactgcatcgaggccaagctcaccaacacgaccaccgcgagccgctgcccgacccagggggagccctccctgaacgaggagcaggacaagcggttcgtgtgcaagcacagcatggtcgaccgcggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctggacttcaacgagatggtgctcctgcagatggagaacaaggcctggctggtgcaccgccagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccggctgcgcatggacaagctgcagctcaagggcatgagctactccatgtgcaccgggaagttcaaggtggtcaaggagatcgcggagacccagcacggcaccatcgtgatccgggtgcagtacgagggggacggcagcccctgcaagatccccttcgagatcatggacctggagaagcgccacgtcctgggccggctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcgcatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccggtccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccgcagcgtgacccggctggagaacctgatgtggaagcagatcacccccgagctcaaccacatcctgtccgagaacgagatcaagctgaccatcatgacgggggacatcaagggcatcatgcaggccgggaagcgcagcctccggccgcagcccaccgagctgaagtactcctggaaggcgtggggcaaggccaagatgctgagcaccgagctccacaaccacaccttcctgatcgacggccccgagacggccgagtgcccgaacaccaaccgcgcctggaactccctggaggtcgaggactacgggttcggcgtgttcaccaccaacatctggctcaagctgaaggagcggcaggacgtgttctgcgacagcaagctgatgtccgccgcgatcaaggacaaccgcgccgtccacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccggccggggtaccacacccagaccgccggcccctggcacctcgggcgcctggagatggacttcgacttctgcgagggcaccacggtggtggtcaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtgaccgccggccacgggcagatcgacaacttcagcctcggcgtcctgggcatggcgctgttcctcgaggagatgctgcggacgcgcgtggggaccaagcacaccatcctgctcgtggccgtctccttcgtgaccctgatcacgggcaacatgagcttccgggacctggggcgcgtggtcgtgatggtgggcgccaccatgaccgacgacatcgggatgggcgtcacctacctcgccctgctggccgcgttcaaggtgcgccccacgttcgccgccggcctcctgctgcggaagctcacctccaaggagctgatgatgaccaccatcgggatcgtgctgctcagccagtccacgatccccgagaccatcctggagctgaccgacgccctcgccctgggcatgatggtcctgaagatcgtgcgcaacatggagaagtaccagctcgcggtcaccatcatggccatcctgtgcgtgccgaacgccgtgatcctgcagaacgcctggaaggtcagctgcacggccctcgcggtggtgtccgtcagccccctgctgctcacctccagccagcagaaggccgactggatccccctggccctgaccatcaaggggctcaaccccaccgccatcttcctgacgaccctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcacggtgtgctacgtgctgaccgggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgacgatcctcatccgcaccggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacgcggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagaccaagcccgggctgttcaagaccaacaccggcacgatcggggccgtgagcctggacttctcccccggcaccagcggctcccccatcgtcgacaagaaggggaaggtggtgggcctctacgggaacggcgtcgtgacccgcagcggcacctacgtgtccgcgatcgcccagacggagaagtccatcgaggacaaccccgagatcgaggacgacatcttccggaagaagcgcctgaccatcatggacctgcaccccggggccggcaagaccaagcggtacctgcccgccatcgtccgcgaggcgatcaagcgggggctccgcaccctgatcctggccccgacgcgggtggtggccgccgagatggaggaggccctccgcggcctgcccatccgctaccagacccccgcgatccgggccgagcacaccgggcgcgagatcgtcgacctgatgtgccacgccaccttcacgatgcggctcctgagccccatccgcgtgccgaactacaacctgatcatcatggacgaggcccacttcaccgaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagaaggagatccccgagcgctcctggaacagcgggcacgagtgggtcaccgacttcaagggcaagaccgtgtggttcgtgccgtccatcaaggccgggaacgacatcgccgcctgcctccggaagaacggcaagaaggtcatccagctgagccgcaagaccttcgactccgagtacatcaagacgcggaccaacgactgggacttcgtggtgaccaccgacatcagcgagatgggcgcgaacttcaaggccgagcgcgtcatcgacccccggcgctgcgtgaagcccgtgatcctgacggacggggaggagcgggtcatcctcgccggccccatgccggtgacccactccagcgccgcccagcgccgggggcgcgtgggccggaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggcccggaacgccctggacaacctcgcggtgctgcacaccgccgaggccgggggccgcgcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcaccgtggtggccgccaccatggccaacgagatgggcttcctggagaagacgaagaaggacttcgggctgggcagcatcaccacccagcagccggagagcaacatcctcgacatcgacctgcgccccgcctccgcgtggaccctgtacgccgtcgccacgaccttcatcacccccatgctccggcacagcatcgagaactccagcgtgaacgtgtccctgaccgccatcgccaaccaggcgacggtcctgatgggcctcgggaagggctggcccctgagcaagatggacatcggggtgccgctgctcgccatcggctgctactcccaggtgaaccccatcaccctgaccgccgccctgctcctgctggtcgcgcactacgccatcatcgggcccggcctccaggccaaggccacccgcgaggcccagaagcgggcggccgccggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcgcaccacgtgggccctgtgcgaggccctgaccctcgcgaccgggcccatcagcaccctgtgggagggcaacccggggcggttctggaacacgaccatcgccgtgtccatggccaacatcttccgcggcagctacctggccggcgccgggctcctgttctccatcatgaagaacaccgcgaacacccgccggggcacggggaacaccggcgagaccctgggcgagaagtggaagaaccgcctcaacgccctgggcaagagcgagttccagacctacaagaagtccggcatccaggaggtggaccggacgctggccaaggaggggatcaagcgcggcgagaccgaccaccacgccgtcagccgggggtccgcgaagctccgctggttcgtggagcggaacctggtgacccccgagggcaaggtcgtggacctgggctgcgggcgcggcgggtggagctactactgcggcgggctcaagaacgtgaaggaggtcaagggcctgaccaagggcgggcccggccacgaggagcccatcccgatgtccacgtacgggtggaacctggtgcggctccagagcggcgtggacgtcttcttcacgccgcccgagaagtgcgacaccctgctgtgcgacatcggggagtccagccccaacccgaccgtggaggccggccgcaccctccgggtgctgaacctggtcgagaactggctcaacaacaacacgcagttctgcatcaaggtgctgaacccctacatgcccagcgtgatcgagaagatggagaccctgcagcgcaagcacggcggggccctggtccggaacccgctctcccgcaacagcacccacgagatgtactgggtgtccaacgccagcggcaacatcgtgtccagcgtcaacatgatctcccggatgctgatcaaccgcttcaccatgcggcacaagaaggccacgtacgagcccgacgtggacctggggagcggcacccgcaacatcgggatcgagtccgagacccccaacctcgacatcatcggcaagcggatcgagaagatcaagcaggagcacgagaccagctggcactacgaccaggaccacccctacaagacgtgggcgtaccacggctcctacgagaccaagcagaccgggagcgcctccagcatggtgaacggcgtcgtgcgcctgctgaccaagccgtgggacgtgatccccatggtcacgcagatggccatgaccgacaccacccccttcgggcagcagcgcgtgttcaaggagaaggtcgacacgcggacccaggagcccaaggagggcaccaagaagctcatgaagatcaccgccgagtggctgtggaaggagctgggcaagaagaagacgccgcgcatgtgcacccgggaggagttcacccgcaaggtgcggtccaacgccgcgctcggggccatcttcaccgacgagaacaagtggaagtccgcccgcgaggccgtggaggactcccggttctgggagctggtcgacaaggagcgcaacctgcacctcgagggcaagtgcgagacgtgcgtgtacaacatgatggggaagcgggagaagaagctgggcgagttcgggaaggccaagggcagccgcgcgatctggtacatgtggctgggcgcccggttcctcgagttcgaggccctggggttcctgaacgaggaccactggttctcccgcgagaacagcctcagcggcgtggagggggagggcctgcacaagctggggtacatcctccgggacgtctccaagaaggagggcggcgccatgtacgcggacgacaccgccgggtgggacacccgcatcaccctggaggacctgaagaacgaggagatggtgacgaaccacatggagggcgagcacaagaagctcgccgaggccatcttccggctgacctaccagaacaaggtggtccgcgtgcagcggcccacgccccgggggaccgtgatggacatcatcagccggcgcgaccagcggggctccgggcaggtcgtgacgtacggcctgaacaccttcaccaacatggaggcccagctcatccgccagatggagggcgagggggtgttcaagagcatccagcacctgaccgtcacggaggagatcgcggtgaagaactggctggtgcgcgtcggccgggagcgcctctcccggatggccatcagcggggacgactgcgtggtgaagcccctggacgaccgcttcgcctccgccctgaccgccctcaacgacatgggcaaggtccggaaggacatccagcagtgggagccgagccgcggctggaacgactggacccaggtgcccttctgctcccaccacttccacgagctgatcatgaaggacgggcgggtgctggtcgtgccctgccgcaaccaggacgagctcatcggccgggcgcgcatcagccagggggccggctggtccctgcgggagaccgcctgcctgggcaagagctacgcccagatgtggtccctcatgtacttccaccgccgggacctgcgcctggccgcgaacgccatctgcagcgccgtgccctcccactgggtcccgaccagccggacgacctggtccatccacgccacccacgagtggatgaccacggaggacatgctcaccgtgtggaaccgcgtgtggatccaggagaacccctggatggaggacaagacccccgtcgagagctgggaggagatcccctacctgggcaagcgggaggaccagtggtgcggcagcctgatcgggctcacctcccgcgccacgtgggcgaagaacatccagaccgccatcaaccaggtgcggagcctgatcggcaacgaggagtacaccgactacatgccgtccatgaagcgcttccgccgggaggaggaggaggccggggtgctgtggtga

SEQ ID NO: 9717 - RNA, 9876 nt, synthetic construct
  misc_feature 1..9876: note = derived and/or modified CDS sequence (opt1) from DENV-2__JN851121__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgcgatggtgcaggccgactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgaccgagaacgaggtcaagctgacgatcatgaccggggacatcaagggcatcatgcaggcggggaagcggtccctccgcccgcagcccaccgagctgaagtacagctggaaggcctggggcaaggccaagatgctgtccaccgagctccacaaccacacgttcctgatcgacggccccgagaccgccgagtgcccgaacaccaaccgggcctggaacagcctggaggtggaggactacgggttcggcgtgttcaccacgaacatctggctcaagctgaaggagcgccaggacgtcttctgcgactccaagctgatgagcgcggccatcaaggacaaccgggccgtgcacgccgacatggggtactggatcgagtccgccctcaacgacacctggaagatcgagaaggcgagcttcatcgaggtgaagtcctgccactggcccaagagccacaccctgtggtccaacggcgtcctggagagcgagatgatcatccccaagaacttcgccggccccgtgtcccagcacaactaccgcccggggtaccacacccagaccgccggcccctggcacctcgggcggctggagatggacttcgacttctgcgagggcacgaccgtggtcgtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtgaacagcctggtcacggcgggccacgggcagatcgacaacttctccctcggcgtgctgggcatggccctgttcctcgaggagatgctgcgcacccgggtggggaccaagcacgccatcctgctcgtcgccgtgagcttcgtgaccctgatcacgggcaacatgtccttccgcgacctggggcgcgtcatggtgatggtgggcgccaccatgaccgacgacatcgggatgggcgtcacctacctcgcgctgctggccgccttcaaggtgcggcccacgttcgccgccggcctcctgctgcgcaagctcaccagcaaggagctgatgatgaccaccatcgggatcgtgctgctctcccagagcacgatccccgagtccatcctggagctgaccgacgcgctcgccctgggcatgatggtcctgaagatcgtgcggaacatggagaagtaccagctcgccgtcaccatcatggccatcctgtgcgtgccgaacgccgtgatcctgcagaacgcgtggaaggtcagctgcaccacgctcgccgtggtgtccgtcagccccctgctgctcacctccagccagcagaaggccgactggatccccctggccctgaccatcaaggggctcaaccccaccgcgatcttcctgacgaccctgtcccgcaccagcaagaagcggtcctggccgctcaacgaggccatcatggccgtgggcatggtgagcatcctggcctccagcctgctcaagaacgacatccccatgaccggccccctggtcgccgggggcctgctcacggtgtgctacgtgctgaccgggcgcagcgcggacctggagctcgagcgggccgccgacgtccgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtgtccatccccatcaccgccgcggcctggtacctgtgggaggtcaagaagcagcgcgccggggtgctgtgggacgtgcccagcccgccgcccgtcggcaaggccgagctcgaggacggggcctaccggatcaagcagaagggcatcctggggtactcccagatcggcgcgggcgtgtacaaggaggggaccttccacaccatgtggcacgtgacgcgcggcgccgtcctgatgcacaaggggaagcggatcgagcccagctgggccgacgtgaagaaggacctcatctcctacggcgggggctggaagctggagggcgagtggaaggagggggaggaggtgcaggtcctggccctcgagcccggcaagaacccccgcgccgtgcagaccaagcccgggctgttcaagaccaacaccggcacgatcggggcggtgagcctggacttctcccccggcaccagcggctcccccatcgtcgacaagaaggggaaggtggtgggcctctacgggaacggcgtcgtgacccggagcggcacctacgtgtccgccatcgcccagacggagaagtccatcgaggacaaccccgagatcgaggacgacatcttccgcaagaagcggctgaccatcatggacctgcaccccggggccggcaagaccaagcgctacctgcccgcgatcgtccgggaggccatcaagcgcgggctccggaccctgatcctggccccgacgcgcgtggtggccgccgagatggaggaggcgctccgcggcctgcccatccggtaccagacccccgccatccgcgccgagcacaccgggcgggagatcgtcgacctgatgtgccacgccaccttcacgatgcgcctcctgagccccatccgggtgccgaactacaacctgatcatcatggacgaggcccacttcaccgaccccgcgtccatcgccgcccgcggctacatcagcacccgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgccgcgtgcctccggaagaacggcaagaaggtcatccagctgagccgcaagaccttcgactccgagtacatcaagacgcggaccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgccggccccatgccggtcacccactccagcgccgcgcagcgccgggggcgcgtgggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtcgacctgatgcggcgcggcgacctccccgtgtggctggcgtaccgggtcgccgccgaggggatcaactacgccgaccgccggtggtgcttcgacggcgtgaagaacaaccagatcctggaggagaacgtggaggtcgagatctggacgaaggagggggagcgcaagaagctcaagccgcggtggctggacgcccgcatctacagcgaccccctggcgctcaaggagttcaaggagttcgccgccggccggaagtccctgaccctgaacctcatcaccgagatgggccgcctgcccaccttcatgacgcagaaggccaagaacgcgctggacaacctcgccgtgctgcacaccgccgaggccgggggccgggcctacaaccacgcgctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcccagatccagccgcactggatcgccgcgtccatcatcctggagttcttcctgatcgtcctcctgatccccgagcccgagaagcagcgcacgccccaggacaaccagctgacctacgtggtgatcgccatcctcaccgtcgtggccgccaccatggccaacgagatgggcttcctggagaagacgaagaaggacttcgggctgggcagcatcaccaaccagcagccggagagcaacatcctcgacatcgacctgcggcccgcgtccgcctggaccctgtacgccgtggccaccacgttcatcacccccatgctccgccacagcatcgagaactccagcgtcaacgtgtccctgaccgccatcgcgaaccaggccaccgtgctgatgggcctcgggaagggctggcccctgagcaagatggacatcggggtcccgctgctcgccatcggctgctactcccaggtgaaccccatcacgctgaccgccgcgctgctcctgctggtggcccactacgccatcatcgggcccggcctccaggccaaggccacccgggaggcgcagaagcgcgccgccgccggcatcatgaagaaccccaccgtcgacgggatgacggtgatcgacctggacccgatcccctacgaccccaagttcgagaagcagctgggccaggtgatgctcctggtcctgtgcgtgacccaggtgctcatgatgcggaccacctgggccctgtgcgaggcgctgacgctcgccaccgggcccatcagcaccctgtgggagggcaacccggggcgcttctggaacaccacgatcgccgtctccatggccaacatcttccgcggcagctacctggccggcgcggggctcctgttctccatcatgaagaacaccgccaacacccggcgcggcaccgggaacacgggcgagaccctgggcgagaagtggaagaaccggctcaacgccctgggcaagagcgagttccagatctacaagaagtccggcatccaggaggtggaccgcaccctggccaaggaggggatcaagcggggcgagaccgaccaccacgcggtgagccgcgggtccgccaagctccggtggttcgtcgagcgcaacctggtgacgcccgagggcaaggtggtcgacctgggctgcgggcggggcgggtggagctactactgcggcgggctcaagaacgtgaaggaggtgaagggcctgaccaagggcgggcccggccacgaggagcccatcccgatgtccacctacgggtggaacctggtccgcctccagagcggcgtggacgtgttcttcacgccgcccgagaagtgcgacacgctgctgtgcgacatcggggagtccagccccaacccgaccgtcgaggccggccggaccctccgcgtgctgaacctggtggagaactggctcaacaacaacacccagttctgcatcaaggtcctgaacccctacatgcccagcgtgatcgagaagatggaggccctgcagcggaagtacggcggggccctggtgcgcaacccgctctcccggaacagcacccacgagatgtactgggtctccaacgcgagcggcaacatcgtgtccagcgtgaacatgatctcccgcatgctgatcaaccggttcacgatgcgccacaagaaggccacctacgagcccgacgtcgacctggggagcggcacccggaacatcgggatcgagtccgagacccccaacctcgacatcatcggcaagcgcatcgagaagatcaagcaggagcacgagacgagctggcactacgaccaggaccacccctacaagacctgggcctaccacggctcctacgagaccaagcagaccgggagcgcctccagcatggtgaacggcgtggtccgcctgctgacgaagccgtgggacgtgatccccatggtgacccagatggccatgaccgacaccacgcccttcgggcagcagcgggtcttcaaggagaaggtggacacccgcacccaggagcccaaggagggcaccaagaagctcatgaagatcacggcggagtggctgtggaaggagctgggcaagaagaagaccccgcggatgtgcacccgcgaggagttcacccggaaggtccgctccaacgccgccctcggggccatcttcacggacgagaacaagtggaagtccgcccgggaggcggtggaggactccggcttctgggagctggtggacaaggagcgcaacctgcacctcgaggggaagtgcgagacctgcgtctacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctcagcggggtggagggcgaggggctgcacaagctgggctacatcctccgggacgtgtccaagaaggagggcggggccatgtacgccgacgacaccgccggctgggacacccgcatcacgctggaggacctgaagaacgaggagatggtcaccaaccacatggagggggagcacaagaagctcgccgaggcgatcttcaagctgacctaccagaacaaggtggtgcgggtccagcgccccacgccccggggcacggtgatggacatcatcagccgccgggaccagcgcgggtccggccaggtggtcacctacggcctgaacaccttcaccaacatggaggcccagctcatccggcagatggagggggagggcgtgttcaagagcatccagcagctgacggtgaaggaggagatcgccgtcaagaactggctgatccgcgtggggcgcgagcggctctcccgcatggccatcagcggcgacgactgcgtggtcaagcccctggacgaccggttcgcctccgcgctgaccgccctcaacgacatgggcaaggtgcgcaaggacatccagcagtgggagccgagccgggggtggaacgactggacccaggtgcccttctgctcccaccacttccacgagctgatcatgaaggacggccgcgtcctggtggtgccctgccggaaccaggacgagctcatcgggcgcgcccggatcagccagggcgccgggtggtccctgcgcgagaccgcctgcctgggcaagagctacgcgcagatgtggtccctcatgtacttccaccggcgcgacctgcggctggccgccaacgccatctgcagcgccgtcccctcccactgggtgccgacgagccgcaccacctggtccatccacgcgacccacgagtggatgaccacggaggacatgctcaccgtgtggaaccgggtctggatccaggagaacccctggatggaggacaagacccccgtggagagctgggaggagatcccctacctgggcaagcgcgaggaccagtggtgcgggagcctgatcggcctcacctcccgggccacgtgggccaagaacatccagaccgccatcaaccaggtgcgcagcctgatcgggaacgaggagtacaccgactacatgccgtccatgaagcggttccgccgcgaggaggaggaggcgggcgtcctgtggtga

SEQ ID NO: 9718 - RNA, 9876 nt, synthetic construct
  misc_feature 1..9876: note = derived and/or modified CDS sequence (opt1) from DENV-2__JN851115__SS-prME
  source 1..9876: mol_type = other RNA
accgcgggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggctcctggacctgcccctcccctggctgccgggcgcggacacccaggggtccaactggatccagaaggagaccctggtgacgttcaagaacccccacgccaagaagcaggacgtcgtggtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctcggccgcctgatcacggtgaacccgatcgtcaccgagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggccatcctgggcgacacggcctgggacttcgggagcctgggcggggtcttcacctccatcggcaaggcgctccaccaggtgttcggggccatctacggcgccgccttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggcggactccgggtgcgtcgtgagctggaagaacaaggagctcaagtgcggcagcggcatcttcatcaccgacaacgtgcacacctggacggagcagtacaagttccagcccgagtcccccagcaagctggcctccgccatccagaaggcccacgaggaggggatctgcggcatccggagcgtcacccgcctggagaacctcatgtggaagcagatcacccccgagctgaaccacatcctgaccgagaacgaggtgaagctcacgatcatgaccggggacatcaagggcatcatgcaggccgggaagcggtccctgcgcccgcagcccaccgagctgaagtacagctggaaggcgtggggcaaggccaagatgctctccaccgagctgcacaaccacacgttcctgatcgacggccccgagaccgccgagtgcccgaacaccaaccgggcctggaacagcctcgaggtggaggactacgggttcggcgtcttcaccacgaacatctggctgaagctgaaggagcgccaggacgtgttctgcgactccaagctcatgagcgccgcgatcaaggacaaccgggccgtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgcgggccccgtgtcccagcacaactaccgcccggggtaccacacccagaccgccggcccctggcacctggggcggctggagatggacttcgacttctgcgagggcacgaccgtcgtggtgaccgaggactgcgggaaccgcggccccagcctccggaccacgaccgccagcggcaagctgatcaccgagtggtgctgccgctcctgcaccctgcccccgctccggtaccgcggggaggacggctgctggtacgggatggagatccggcccctgaaggagaaggaggagaacctggtcaacagcctcgtgacggccggccacgggcagatcgacaacttctccctgggcgtgctgggcatggccctcttcctggaggagatgctgcgcacccgggtcgggaccaagcacgccatcctcctggtggccgtgagcttcgtcaccctgatcacgggcaacatgtccttccgcgacctcgggcgcgtgatggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagtccatcctggagctcaccgacgccctggcgctgggcatgatggtgctcaagatcgtccggaacatggagaagtaccagctggccgtgaccatcatggccatcctgtgcgtgccgaacgccgtcatcctccagagcgcctggaaggtgtcctgcaccacgctggcggtggtcagcgtgagccccctgctcctgaccagctcccagcagaaggccgactggatccccctggccctcaccatcaaggggctgaaccccaccgccatcttcctgacgaccctcagccgcacctccaagaagcggagctggccgctgaacgaggcgatcatggccgtgggcatggtctccatcctggccagcagcctcctgaagaacgacatccccatgaccggccccctggtggccgggggcctcctgacggtgtgctacgtcctgaccgggcgctccgccgacctcgagctggagcgggcggccgacgtgcgctgggaggagcaggccgagatcagcggctccagccccatcctgtccatcaccatcagcgaggacgggtccatgagcatcaagaacgaggaggaggagcagaccctcacgatcctgatccggaccggcctgctcgtgatctccggcctgttcccggtcagcatccccatcaccgccgccgcgtggtacctgtgggaggtgaagaagcagcgcgccggggtgctctgggacgtccccagcccgccgcccgtgggcaaggccgagctggaggacggggcctaccggatcaagcagaagggcatcctggggtacagccagatcggcgccggcgtgtacaaggaggggaccttccacaccatgtggcacgtcacgcgcggcgcggtgctcatgcacaaggggaagcggatcgagccctcctgggccgacgtgaagaaggacctgatcagctacggcgggggctggaagctggagggcgagtggaaggagggggaggaggtccaggtgctcgccctggagcccggcaagaacccccgcgccgtgcagaccaagcccgggctgttcaagaccaacaccggcacgatcggggccgtctccctcgacttcagccccggcacctccggcagccccatcgtggacaagaaggggaaggtggtcggcctgtacgggaacggcgtggtgacccggtccggcacctacgtcagcgcgatcgcccagacggagaagtccatcgaggacaaccccgagatcgaggacgacatcttccgcaagaagcggctgaccatcatggacctgcaccccggggccggcaagaccaagcgctacctccccgccatcgtgcgggaggcgatcaagcgcgggctgcggaccctgatcctcgccccgacgcgcgtggtcgccgccgagatggaggaggccctgcgcggcctgcccatccggtaccagacccccgcgatccgcgccgagcacaccgggcgggagatcgtggacctcatgtgccacgccaccttcacgatgcgcctgctgtcccccatccgggtgccgaactacaacctcatcatcatggacgaggcccacttcaccgaccccgccagcatcgcggcccgcggctacatctccacccgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctgcggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctcacggacggggaggagcgggtcatcctggccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgggagaaggtcgacgccatcgacggcgagtaccgcctgcgcggggaggcccgcaagaccttcgtggacctcatgcggcgcggcgacctgcccgtctggctggcctaccgggtggcggccgaggggatcaactacgccgaccgccggtggtgcttcgacggcgtgaagaacaaccagatcctcgaggagaacgtcgaggtggagatctggacgaaggagggggagcgcaagaagctgaagccgcggtggctggacgcccgcatctactccgaccccctcgccctgaaggagttcaaggagttcgcggccggccggaagtccctgaccctcaacctgatcaccgagatgggccgcctgcccaccttcatgacgcagaaggccaagaacgccctcgacaacctggcggtgctgcacaccgccgaggccgggggccgggcctacaaccacgccctctccgagctgcccgagaccctggagaccctcctgctgctcacgctgctggcgaccgtcaccgggggcatcttcctcttcctgatgagcggcaaggggatcggcaagatgaccctggggatgtgctgcatcatcaccgcctccatcctcctgtggtacgcccagatccagccgcactggatcgccgccagcatcatcctggagttcttcctcatcgtgctgctgatccccgagcccgagaagcagcgcacgccccaggacaaccagctcacctacgtggtcatcgcgatcctgaccgtggtggccgccaccatggccaacgagatgggcttcctggagaagacgaagaaggacttcgggctcggcagcatcaccacccagcagccggagtccaacatcctggacatcgacctgcggcccgccagcgcgtggaccctctacgccgtcgccacgaccttcatcacccccatgctgcgccactccatcgagaacagctccgtgaacgtgagcctgaccgccatcgccaaccaggcgacggtcctcatgggcctggggaagggctggcccctgtccaagatggacatcggggtgccgctcctggccatcggctgctacagccaggtgaaccccatcaccctgaccgccgccctcctgctgctcgtcgcgcactacgccatcatcgggcccggcctgcaggccaaggccacccgggaggcccagaagcgcgcggccgccggcatcatgaagaaccccacggtggacgggatgaccgtgatcgacctggacccgatcccctacgaccccaagttcgagaagcagctcggccaggtcatgctgctggtgctctgcgtgacccaggtcctgatgatgcggaccacgtgggccctgtgcgaggccctcaccctggcgaccgggcccatctccaccctgtgggagggcaacccggggcgcttctggaacacgaccatcgccgtgagcatggccaacatcttccgcggctcctacctcgccggcgccgggctgctgttcagcatcatgaagaacaccgcgaacacccggcgcggcacggggaacaccggcgagaccctcggcgagaagtggaagaaccggctgaacgccctggggaagtccgagttccagatctacaagaagtccggcatccaggaggtggaccgcaccctcgccaaggaggggatcaagcggggcgagacggaccaccacgccgtctcccgcgggagcgcgaagctgcggtggttcgtggagcgcaacctggtgacccccgagggcaaggtcgtggacctcggctgcgggcggggcgggtggtcctactactgcggcgggctgaagaacgtgaaggaggtcaagggcctgaccaagggcgggcccggccacgaggagcccatcccgatgagcacctacgggtggaacctcgtgcgcctgcagtccggcgtggacgtcttcttcacgccgcccgagaagtgcgacaccctgctctgcgacatcggggagagcagccccaacccgaccgtggaggccggccggaccctgcgcgtgctgaacctcgtcgagaactggctgaacaacaacacccagttctgcatcaaggtgctgaacccctacatgccctccgtgatcgagaagatggaggccctgcagcggaagtacggcggggccctcgtccgcaacccgctgagccggaactccacgcacgagatgtactgggtgagcaacgcctccggcaacatcgtgagctccgtcaacatgatcagccgcatgctgatcaaccggttcaccatgcgccacaagaaggcgacctacgagcccgacgtggacctcgggtccggcacccggaacatcgggatcgagagcgagacgcccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccgtgggacgtgatccccatggtcacccagatggccatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagaccccgcggatgtgcacccgcgaggagttcacgcggaaggtgcgcagcaacgcggccctgggggccatcttcaccgacgagaacaagtggaagtccgcccgggaggccgtggaggacagcggcttctgggagctggtcgacaaggagcgcaacctccacctggaggggaagtgcgagacctgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgagaacagcctgtccggggtggagggcgaggggctgcacaagctcggctacatcctgcgggacgtcagcaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgccccacgccccggggcaccgtgatggacatcatctcccgccgggaccagcgcgggagcggccaggtcgtgacctacggcctcaacaccttcacgaacatggaggcgcagctgatccggcagatggagggggagggcgtgttcaagtccatccagcagctgaccgtcaaggaggagatcgccgtgaagaactggctcatccgcgtggggcgcgagcggctgagccgcatggccatctccggcgacgactgcgtcgtgaagcccctggacgaccggttcgccagcgccctcaccgcgctgaacgacatgggcaaggtgcgcaaggacatccagcagtgggagccgtcccgggggtggaacgactggacccaggtccccttctgcagccaccacttccacgagctgatcatgaaggacggccgcgtgctcgtggtcccctgccggaaccaggacgagctgatcgggcgcgcccggatctcccagggcgccgggtggagcctgcgcgagacggcctgcctcggcaagtcctacgcccagatgtggagcctgatgtacttccaccggcgcgacctgcggctcgcggccaacgccatctgctccgccgtgcccagccactgggtgccgacctcccgcaccacctggagcatccacgccacccacgagtggatgacgaccgaggacatgctgaccgtctggaaccgggtgtggatccaggagaacccctggatggaggacaagacccccgtggagagctgggaggagatcccctacctgggcaagcgcgaggaccagtggtgcgggtccctcatcggcctgacgagccgggcgacctgggccaagaacatccagaccgccatcaaccaggtccgctccctgatcgggtacgaggagtacaccgactacatgccgagcatgaagcggttccgccgcgaggaggaggaggccggcgtgctctggtga

SEQ ID NO: 9719 - RNA, 9876 nt, synthetic construct
  misc_feature 1..9876: note = derived and/or modified CDS sequence (opt1) from DENV-2__JN851127__SS-prME
  source 1..9876: mol_type = other RNA
accgccggcatcatcatcatgatgatccccaccgtgatggccttccacctgaccacccggaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctcaagcagaacgagcccgaggacatcgactgctggtgcaacagcacctccacctgggtgacctacgggacctgcaccgccaccggcgagcaccgccgggagaagcgcagcgtcgccctggtgccccacgtgggcatggggctggagacccggaccgagacctggatgtccagcgagggcgcctggaagcacgcccagcgcatcgagacctgggtcctccggcaccccgggttcaccatcatggcggccatcctggcctacaccatcggcaccacctacttccagcgcgtgctgatcttcatcctcctgaccgccgtggcgccctccatgaccatgcggtgcatcgggatcagcaaccgcgacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcggaagtactgcatcgaggccaagctcaccaacacgaccaccgcgagccgctgcccgacccagggggagccctccctgagcgaggagcaggacaagcggttcgtgtgcaagcactccatggtcgaccgcggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccacagcggcgaggagaacgccgtggggaacgacacgggcaagcacgggaaggagatcaaggtgaccccgcagtccagcatcaccgaggccgagctgaccggctacgggaccgtcacgatggagtgcagcccccggaccggcctggacttcaacgagatggtgctcctgcagatggagaacaaggcctggctggtgcaccgccagtggttcctcgacctgcccctgccctggctcccgggcgcggacacccaggggagcaactggatccagaaggagaccctggtcacgttcaagaacccccacgccaagaagcaggacgtggtcgtgctgggcagccaggagggggccatgcacaccgccctcaccggcgccaccgagatccagatgtccagcgggaacctgctgttcacgggccacctcaagtgccggctgcgcatggacaagctgcagctcaagggcatgtcctacagcatgtgcaccgggaagttcaaggtggtcaaggagatcgcggagacccagcacggcaccatcgtgatccgggtgcagtacgagggggacggctccccctgcaagatccccttcgagatcatggacctggagaagcgccacgtcctgggccggctcatcacggtgaacccgatcgtgaccgagaaggacagccccgtcaacatcgaggccgagccgcccttcggggactcctacatcatcatcggcgtggagccggggcagctgaagctgagctggttcaagaagggctccagcatcgggcagatgttcgagaccaccatgcgcggcgccaagcgcatggccatcctcggcgacacggcctgggacttcgggtccctgggcggggtgttcaccagcatcggcaaggcgctgcaccaggtcttcggggccatctacggcgccgccttctccggcgtgagctggaccatgaagatcctcatcggggtggtcatcacctggatcggcatgaactcccggagcacgtccctgagcgtgtccctggtgctggtcggggtggtgaccctctacctgggcgtcatggtgcaggcggacagcgggtgcgtggtcagctggaagaacaaggagctgaagtgcggctccggcatcttcatcaccgacaacgtgcacacctggacggagcagtacaagttccagcccgagagcccctccaagctcgccagcgccatccagaaggcccacgaggaggggatctgcggcatccgctccgtgacccggctggagaacctgatgtggaagcagatcacccccgagctcaaccacatcctgagcgagaacgagatcaagctgaccatcatgacgggggacatcaagggcatcatgcaggccgggaagcgctccctccggccgcagcccatcgagctgaagtacagctggaaggcgtggggcaaggccaagatgctgtccaccgagctccacaaccacaccttcctgatcgacggccccgagaccgccgagtgcccgaacacgaaccgcgcctggaacagcctggaggtcgaggactacgggttcggcgtgttcaccaccaacatctggctcaagctgaaggagcggcaggacgtgttctgcgactccaagctgatgagcgccgtcatcaaggacaaccgcgcggtgcacgccgacatggggtactggatcgagtccgccctcaacgacacctggaagatcgagaaggccagcttcatcgaggtgaagtcctgccactggcccaagagccacacgctgtggtccaacggcgtcctggagagcgagatgatcatccccaagaacttcgccggccccgtgagccagcacaactaccggccggggtaccacacccagaccgcgggcccctggcacctcgggcgcctggagatggacttcgacttctgcgagggcaccaccgtggtcgtgacggaggactgcgggaaccggggcccctccctgcgcaccaccaccgccagcggcaagctcatcacggagtggtgctgccggtcctgcaccctgcccccgctgcgctaccgcggggaggacggctgctggtacgggatggagatccgccccctcaaggagaaggaggagaacctggtgaacagcctggtcaccgccggccacgggcagatcgacaacttctccctcggcgtgctgggcatggccctgttcctcgaggagatgctgcggacccgcgtggggacgaagcacgcgatcctgctcgtcgccgtgagcttcgtgaccctgatcaccggcaacatgtccttccgggacctggggcgcgtcatggtgatggtgggcgccaccatgacggacgacatcgggatgggcgtcacctacctcgccctgctggccgcgttcaaggtgcgccccaccttcgccgccggcctcctgctgcggaagctcaccagcaaggagctgatgatgacgaccatcgggatcgtgctgctctcccagagcaccatccccgagaccatcctggagctgacggacgccctcgccctgggcatgatggtcctgaagatcgtgcgcaacatggagaagtaccagctcgcggtcaccatcatggccatcctgtgcgtgccgaacgccgtgatcctgcagaacgcctggaaggtctcctgcaccaccctcgccgtggtgagcgtcagccccctgctgctcacgagctcccggcagaaggcggactggatccccctggccctgaccatcaaggggctcaaccccaccgccatcttcctgaccacgctgagccgcacctccaagaagcggagctggccgctcaacgaggccatcatggcggtgggcatggtgtccatcctggccagcagcctgctcaagaacgacatccccatgaccggccccctggtcgccgggggcctgctcaccgtgtgctacgtgctgacggggcgctccgccgacctggagctcgagcgggccgcggacgtccgctgggaggagcaggccgagatcagcggctccagccccatcctgtccatcaccatcagcgaggacgggtccatgagcatcaagaacgaggaggaggagcagaccctgaccatcctcatccggacgggcctgctggtgatctccggcctcttcccggtgagcatccccatcaccgccgccgcctggtacctgtgggaggtcaagaagcagcgcgcgggggtgctgtgggacgtgcccagcccgccgcccgtcggcaaggccgagctcgaggacggggcctaccggatcaagcagaagggcatcctggggtacagccagatcggcgccggcgtgtacaaggaggggaccttccacaccatgtggcacgtgacccgcggcgccgtcctgatgcacaaggggaagcggatcgagccctcctgggcggacgtgaagaaggacctcatcagctacggcgggggctggaagctggagggcgagtggaaggagggggaggaggtgcaggtcctggccctcgagcccggcaagaacccccgcgccgtgcagacgaagcccgggctgttcaagaccaacaccggcaccatcggggccgtgtccctggacttcagccccggcacgtccggcagccccatcgtcgacaagaaggggaaggtggtgggcctctacgggaacggcgtcgtgacccggtccggcacctacgtgagcgccatcgcgcagaccgagaagtccatcgaggacaaccccgagatcgaggacgacatcttccgcaagaagcggctgacgatcatggacctgcaccccggggccggcaagaccaagcgctacctgcccgccatcgtccgggaggccatcaagcgcgggctccggaccctgatcctggcgccgacccgcgtggtggccgccgagatggaggaggccctccgcggcctgcccatccggtaccagacgcccgccatccgcgcggagcacaccgggcgggagatcgtcgacctgatgtgccacgccaccttcaccatgcgcctcctgtcccccatccgggtgccgaactacaacctgatcatcatggacgaggcccacttcacggaccccgccagcatcgccgcgcgcggctacatctccacccgggtggagatgggcgaggccgccgggatcttcatgaccgccacgccgcccggcagccgcgacccgttcccccagtccaacgcccccatcatggacgaggagcgggagatccccgagcgcagctggaactccgggcacgagtgggtcacggacttcaagggcaagaccgtgtggttcgtgccgagcatcaaggcggggaacgacatcgccgcctgcctccggaagaacggcaagaaggtcatccagctgtcccgcaagaccttcgacagcgagtacatcaagacccggacgaacgactgggacttcgtggtgaccaccgacatctccgagatgggcgccaacttcaaggcggagcgcgtcatcgacccccggcgctgcatgaagcccgtgatcctgaccgacggggaggagcgggtgatcctcgccggccccatgccggtcacgcacagctccgccgcccagcgccgggggcgcgtgggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccgcaagaccttcgtcgacctgatgcggcgcggcgacctccccgtgtggctggcctaccgggtcgccgcggaggggatcaactacgccgaccgccggtggtgcttcgacggcgtgaagaacaaccagatcctggaggagaacgtggaggtcgagatctggaccaaggagggggagcgcaagaagctcaagccgcggtggctggacgcccgcatctactccgaccccctggccctcaaggagttcaaggagttcgccgcgggccggaagtccctgacgctgaacctcatcaccgagatgggccgcctgcccaccttcatgacccagaaggcccggaacgccctggacaacctcgccgtgctgcacacggcggaggccgggggccgcgcctacaaccacgccctgtccgagctccccgagaccctggagaccctgctcctgctgaccctcctggccacggtgaccgggggcatcttcctgttcctcatgagcggcaaggggatcggcaagatgaccctggggatgtgctgcatcatcaccgcgtccatcctgctctggtacgcccagatccagccgcactggatcgccgccagcatcatcctggagttcttcctgatcgtcctcctgatccccgagcccgagaagcagcggacgccccaggacaaccagctgacgtacgtggtgatcgccatcctcaccgtcgtggcggccaccatggccaacgagatgggcttcctggagaagaccaagaaggacttcgggctgggcagcatcacgacccagcagccggagtccaacatcctcgacatcgacctgcgccccgccagcgcctggaccctgtacgcggtggccaccacgttcatcacccccatgctccggcactccatcgagaacagctccgtcaacgtgagcctgaccgccatcgccaaccaggccaccgtgctgatgggcctcgggaagggctggcccctgtccaagatggacatcggggtcccgctgctcgcgatcggctgctacagccaggtgaaccccatcacgctgaccgccgccctgctcctgctggtggcccactacgcgatcatcgggcccggcctccaggccaaggccacccgcgaggcccagaagcgggccgcggccggcatcatgaagaaccccaccgtcgacgggatcacggtgatcgacctggacccgatcccctacgaccccaagttcgagaagcagctgggccaggtgatgctcctggtcctgtgcgtgacccaggtgctcatgatgcgcaccacctgggccctgtgcgaggccctgacgctcgccaccgggcccatctccaccctgtgggagggcaacccggggcgcttctggaacaccacgatcgcggtcagcatggccaacatcttccggggctcctacctggccggcgccgggctcctgttcagcatcatgaagaacaccgccaacacccgccggggcaccgggaacacgggcgagaccctgggcgagaagtggaagaaccgcctcaacgcgctggggaagtccgagttccagatctacaagaagtccggcatccaggaggtggaccggaccctggccaaggaggggatcaagcgcggcgagaccgaccaccacgccgtgtcccgggggagcgccaagctccgctggttcatcgagcggaacctggtcacgcccgagggcaaggtggtggacctgggctgcgggcgcggcgggtggtcctactactgcggcgggctcaagaacgtcaaggaggtgaagggcctgaccaagggcgggcccggccacgaggagcccatcccgatgagcacctacgggtggaacctggtgcggctccagtccggcgtcgacgtgttcttcacgccgcccgagaagtgcgacacgctgctgtgcgacatcggggagagcagccccaacccgaccgtggaggcgggccgcaccctccgggtcctgaacctggtggagaactggctcaacaacaacacccagttctgcatcaaggtgctgaacccctacatgccctccgtcatcgagaagatggaggccctgcagcgcaagtacggcggggccctggtgcggaacccgctcagccgcaactccacccacgagatgtactgggtgagcaacgcctccggcaacatcgtcagctccgtgaacatgatcagccggatgctgatcaaccgcttcacgatgcggcacaagaaggccacctacgagcccgacgtggacctggggtccggcacccgcaacatcgggatcgagagcgagacccccaacctcgacatcatcggcaagcgcatcgagaagatcaagcaggagcacgagacgtcctggcactacgaccaggaccacccctacaagacctgggcgtaccacggcagctacgagaccaagcagaccgggtccgccagctccatggtcaacggcgtggtgcggctgctgacgaagccgtgggacgtcatccccatggtgacccagatggccatgaccgacaccacgcccttcgggcagcagcgcgtgttcaaggagaaggtcgacacccggacccaggagcccaaggagggcaccaagaagctcatgaagatcacggccgagtggctgtggaaggagctgggcaagcgcaagaccccgcggatgtgcacccgcgaggagttcacccggaaggtgcgcagcaacgccgcgctcggggccatcttcacggacgagaacaagtggaagtccgcccgggaggccgtcgaggacagcggcttctgggagctggtggacaaggagcgcaacctgcacctcgaggggaagtgcgagacctgcgtgtacaacatgatgggcaagcgggagaagaagctgggggagttcggcaaggccaagggctcccgcgcgatctggtacatgtggctgggggcccggttcctcgagttcgaggccctgggcttcctgaacgaggaccactggttcagccgcgagaacagcctctccggggtcgagggcgaggggctgcacaagctgggctacatcctccgggacgtgagcaagaaggagggcggggccatgtacgcggacgacaccgccggctgggacacccgcatcacgctggaggacctgaagaacgaggagatggtgaccaaccacatggagggggtccacaagaagctcgccgaggccatcttccggctgacctaccagaacaaggtggtgcgcgtccagcggcccacgccccggggcacggtgatggacatcatctcccggcgcgaccagcgcgggagcggccaggtggtcacctacggcctgaacaccttcaccaacatggaggcccagctcatccggcagatggagggggagggcgtgttcaagtccatccagcacctgacggtgaccgaggagatcgcggtcaagaactggctggtgcgcgtggggcgggagcgcctcagccggatggccatctccggcgacgactgcgtcgtgaagcccctggacgaccgcttcgccagcgccctgaccgccctcaacgacatgggcaaggtgcggaaggacatccagcagtgggagccgtcccgcgggtggaacgactggacccaggtccccttctgcagccaccacttccacgagctgatcatgaaggacggccgggtgctggtggtcccctgccgcaaccaggacgagctcatcgggcgggcgcgcatctcccagggcgccgggtggagcctgcgggagacggcctgcctgggcaagtcctacgcccagatgtggagcctcatgtacttccaccgccgggacctgcgcctggccgcgaacgccatctgctccgccgtgcccagccactgggtgccgacctcccggaccacctggagcatccacgccacccacgagtggatgacgaccgaggacatgctcaccgtctggaaccgcgtgtggatccaggagaacccctggatggaggacaagacccccatcgagagctgggaggagatcccctacctgggcaagcgggaggaccagtggtgcgggtccctgatcggcctcacgagccgcgccacctgggcgaagaacatccagaccgccatcaaccaggtgcgctccctgatcgggaacgaggagtacaccgactacatgccgagcatgaagcggttccgccgggaggaggaggaggccggcgtcctgtggtga

SEQ ID NO: 9720 - RNA, 9876 nt, synthetic construct
  misc_feature 1..9876: note = derived and/or modified CDS sequence (opt1) from DENV-2__JN851120__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccgtcggcaccacctacttccagcgggtgctgatcttcatcctcctgacggccgtgaccccctccatggcgatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaaggtcgtgcagcccgagaacctcgagtacaccatcgtgatcacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccgcaccggcctggacttcaacgagatggtcctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtggtcctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctggagaagcggcacgtgctgggccgcctcatcacggtcaacccgatcgtgaccgagaaggactcccccgtgaacatcgaggccgagccgcccttcggggacagctacatcatcatcggcgtcgagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtgttcggggccatctacggcgccgccttcagcggcgtctcctggaccatgaagatcctcatcggggtggtgatcacctggatcggcatgaacagccgctccacgagcctgtccgtcagcctggtgctggtgggggtcgtgaccctctacctgggcgtgatggtccaggcggactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtcgaggactacgggttcggcgtgttcaccacgaacatctggctcaagctgaaggagcgccaggacgtgttctgcgactccaagctgatgagcgccgcgatcaaggacaaccgggccgtccacgccgacatggggtactggatcgagtccgccctcaacgacacctggaagatcgagaaggccagcttcatcgaggtgaagtcctgccactggcccaagagccacaccctgtggtccaacggcgtgctggagagcgagatgatcatccccaagaacttcgcgggccccgtctcccagcacaactaccgcccggggtaccacacccagaccgccggcccctggcacctcgggcggctggagatggacttcgacttctgcgagggcacgaccgtggtggtcaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtgaacagcctggtgacggccggccacgggcagatcgacaacttctccctcggcgtcctgggcatggcgctgttcctcgaggagatgctgcgcacccgggtggggaccaagcacgccatcctgctcgtggccgtcagcttcgtgaccctgatcacgggcaacatgtccttccgcgacctggggcgcgtgatggtcatggtgggcgccaccatgaccgacgacatcgggatgggcgtgacctacctcgccctgctggcggccttcaaggtccggcccacgttcgccgccggcctcctgctgcgcaagctcaccagcaaggagctgatgatgaccaccatcgggatcgtgctgctctcccagagcacgatccccgagtccatcctggagctgaccgacgccctcgcgctgggcatgatggtcctgaagatcgtgcggaacatggagaagtaccagctcgccgtgaccatcatggccatcctgtgcgtcccgaacgccgtgatcctgcagaacgcctggaaggtgagctgcaccacgctcgcggtcgtgtccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtcggcatggtgagcatcctggcctccagcctgctcaagaacgacatccccatgaccggccccctggtggccgggggcctgctcacggtctgctacgtgctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtcatcagcggcctcttcccggtgtccatccccatcaccgccgccgcgtggtacctgtgggaggtgaagaagcagcgcgccggggtcctgtgggacgtgcccagcccgccgcccgtgggcaaggccgagctcgaggacggggcctaccggatcaagcagaagggcatcctggggtactcccagatcggcgccggcgtctacaaggaggggaccttccacaccatgtggcacgtgacgcgcggcgcggtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacaccggcacgatcggggccgtgagcctggacttctcccccggcaccagcggctcccccatcgtggacaagaaggggaaggtcgtgggcctctacgggaacggcgtggtcacccggagcggcacctacgtgtccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtcgtggccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtcccgaactacaacctgatcatcatggacgaggcccacttcaccgaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctccggaagaacggcaagaaggtgatccagctgagccgcaagaccttcgactccgagtacatcaagacgcggaccaacgactgggacttcgtcgtgaccaccgacatcagcgagatgggcgcgaacttcaaggccgagcgcgtgatcgacccccggcgctgcatgaagcccgtcatcctgacggacggggaggagcgggtgatcctcgccggccccatgccggtgacccactccagcgccgcccagcgccgggggcgcgtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtcgacctgatgcggcgcggcgacctccccgtgtggctggcctaccgggtggcggccgaggggatcaactacgccgaccgccggtggtgcttcgacggcgtcaagaacaaccagatcctggaggagaacgtggaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggccaagaacgccctggacaacctcgcggtcctgcacaccgccgaggccgggggccgggcctacaaccacgccctgagcgagctccccgagaccctggagaccctgctcctgctgacgctcctggcgaccgtgaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgcgatcctcaccgtggtcgccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtggccacgaccttcatcacccccatgctccgccacagcatcgagaactccagcgtgaacgtctccctgaccgccatcgccaaccaggcgacggtgctgatgggcctcgggaagggctggcccctgagcaagatggacatcggggtgccgctgctcgccatcggctgctactcccaggtcaaccccatcaccctgaccgccgccctgctcctgctggtggcgcactacgccatcatcgggcccggcctccaggccaaggccacccgggaggcccagaagcgcgcggccgccggcatcatgaagaaccccacggtggacgggatgaccgtcatcgacctggacccgatcccctacgaccccaagttcgagaagcagctgggccaggtgatgctcctggtgctgtgcgtcacccaggtgctcatgatgcggaccacgtgggccctgtgcgaggccctgaccctcgcgaccgggcccatcagcaccctgtgggagggcaacccggggcgcttctggaacacgaccatcgccgtgtccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctgggcaagagcgagttccagatctacaagaagtccggcatccaggaggtcgaccgcaccctggccaaggaggggatcaagcggggcgagacggaccaccacgccgtgagccgcgggtccgcgaagctccggtggttcgtggagcgcaacctggtcacccccgagggcaaggtggtggacctgggctgcgggcggggcgggtggagctactactgcggcgggctcaagaacgtcaaggaggtgaagggcctgaccaagggcgggcccggccacgaggagcccatcccgatgtccacctacgggtggaacctggtgcgcctccagagcggcgtcgacgtgttcttcacgccgcccgagaagtgcgacaccctgctgtgcgacatcggggagtccagccccaacccgaccgtggaggccggccggaccctccgcgtcctgaacctggtggagaactggctcaacaacaacacccagttctgcatcaaggtgctgaacccctacatgcccagcgtcatcgagaagatggaggccctgcagcggaagtacggcggggccctggtgcgcaacccgctctcccggaacagcacgcacgagatgtactgggtgtccaacgccagcggcaacatcgtctccagcgtgaacatgatctcccgcatgctgatcaaccggttcaccatgcgccacaagaaggcgacctacgagcccgacgtggacctggggagcggcacccggaacatcgggatcgagtccgagacgcccaacctcgacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctgaccaagccgtgggacgtcatccccatggtgacccagatggccatgaccgacacgacccccttcgggcagcagcgggtcttcaaggagaaggtggacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgctccaacgcggccctcggggccatcttcaccgacgagaacaagtggaagtccgcccgggaggccgtcgaggactccggcttctgggagctggtggacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtcgagggcgaggggctgcacaagctgggctacatcctccgggacgtgtccaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtcgtgcgggtgcagcgccccacgccccggggcaccgtcatggacatcatcagccgccgggaccagcgcgggtccggccaggtggtgacctacggcctgaacaccttcacgaacatggaggcgcagctcatccggcagatggagggggagggcgtcttcaagagcatccagcagctgaccgtgaaggaggagatcgccgtgaagaactggctgatccgcgtcgggcgcgagcggctctcccgcatggccatcagcggcgacgactgcgtggtgaagcccctggacgaccggttcgcctccgccctgaccgcgctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgccgggtggtccctgcgcgagacggcctgcctgggcaagagctacgcccagatgtggtccctcatgtacttccaccggcgcgacctgcggctggcggccaacgccatctgcagcgccgtgccctcccactgggtcccgaccagccgcaccacctggtccatccacgccacccacgagtggatgacgaccgaggacatgctcaccgtgtggaaccgggtgtggatccaggagaacccctggatggaggacaagacccccgtcgagagctgggaggagatcccctacctgggcaagcgcgaggaccagtggtgcgggagcctgatcggcctcacgtcccgggcgacctgggccaagaacatccagaccgccatcaaccaggtgcgcagcctgatcgggaacgaggagtacaccgactacatgccgtccatgaagcggttccgcatcgaggaggaggaggccggcgtgctgtggtga

SEQ ID NO: 9721 - RNA, 9876 nt, synthetic construct
  misc_feature 1..9876: note = derived and/or modified CDS sequence (opt1) from DENV-2__JN851131__SS-prME
  source 1..9876: mol_type = other RNA
accgcgggcgtgatcatcatgatgatccccaccgtgatggccttccacctgaccacccggaacggggagccccacatgatcgtgagccggcaggagaagggcaagtccctcctgttcaagaccgagaacggggtgaacatgtgcaccctgatggcgatcgacctcggcgagctgtgcgaggacaccatcacctacaactgccccctgctccgccagaacgagcccgaggacatcgactgctggtgcaacagcacctccacctgggtcacctacgggacctgcaccgccaccggcgagcaccggcgcgagaagcggagcgtggccctggtgccccacgtcggcatggggctggagacccgcaccgagacctggatgtccagcgagggcgcctggaagcacgcccagcggatcgagacctgggtgctccgccaccccgggttcaccatcatggcggccatcctggcctacaccatcggcaccacctacttccagcgggtgctgatcttcatcctcctgaccgccgtcgcgccctccatgaccatgcgctgcatcgggatcagcaaccgggacttcgtggagggcgtgtccggcgggagctgggtcgacatcgtgctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaaggaggagcaggacaagcgcttcgtctgcaagcacagcatggtggaccggggctggggcaacgggtgcggcctgttcgggaagggcgggatcgtgacgtgcgccatgttcacgtgcaagaagaacatggagggcaaggtcgtgcagcccgagaacctcgagtacaccatcgtgatcacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccgcaccggcctggacttcaacgagatggtcctcctgcagatggaggacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtggtcctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctggagaagcggcacgtgctgggccgcctcatcacggtcaacccgatcgtgaccgagaaggactcccccgtgaacatcgaggccgagccgcccttcggggacagctacatcatcatcggcgtcgagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtgttcggggccatctacggcgccgccttcagcggcgtctcctggaccatgaagatcctcatcggggtggtgatcacctggatcggcatgaacagccgctccacgagcctgtccgtcagcctggtgctggtgggggtcgtgaccctctacctgggcgtgatggtccaggcggactccgggtgcgtggtgagctggaagaacaaggagctgaagtgcggcagcggcatcttcatcaccgacaacgtccacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtgaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtcgaggactacgggttcggcgtgttcaccacgaacatctggctcaagctgaaggagcgccaggaggtgttctgcgacagcaagctgatgtccgccgccatcaaggacaaccgggcggtccacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggaagctggagatggacttcgacttctgcgagggcacgaccgtggtggtcaccgaggactgcgggaaccggggccccagcctgcgcaccacgaccgcctccggcaagctcatcaccgagtggtgctgccggagctgcaccctgcccccgctgcgctaccgcggggaggacggctgctggtacgggatggagatccgcccctccaaggagaaggaggagaacctcgtgaacagcctggtgacggccggccacgggcagatcgacaacttctccctgggcgtcctcggcatggccctgttcctggaggagatgctccggacccgcgtggggaccaagcacgcgatcctgctggtggccgtcagcttcgtgaccctcatcacgggcaacatgtccttccgggacctggggcgcgtgatggtcatggtgggcgccaccatgaccgacgacatcgggatgggcgtgacctacctggccctcctggccgcgttcaaggtccgccccacgttcgccgccggcctgctcctgcggaagctgaccagcaaggagctcatgatgaccaccatcgggatcgtgctgctgtcccagagcacgatccccgagaccatcctcgagctgaccgacgccctggccctcggcatgatggtcctgaagatcgtgcgcaacatggagaagtaccagctggcggtgaccatcatggccatcctctgcgtcccgaacgccgtgatcctgcagaacgcctggaaggtgtcctgcacgaccctggccgtcgtgagcgtgagccccctgctgctgaccagctcccagcagaaggcggactggatccccctcgccctgaccatcaaggggctgaaccccacggccatcttcctcaccaccctgagccggacctccaagaagcgcagctggccgctgaacgaggccatcatggcggtcggcatggtgtccatcctcgccagcagcctgctgaagaacgacatccccatgacgggccccctcgtggccgggggcctgctgaccgtctgctacgtgctcaccgggcggtccgccgacctggagctggagcgcgccgcggacgtgcggtgggaggagcaggccgagatcagcggctccagccccatcctctccatcaccatcagcgaggacgggtccatgagcatcaagaacgaggaggaggagcagacgctgaccatcctgatccgcaccggcctcctggtcatctccggcctgttcccggtgagcatccccatcaccgccgccgcctggtacctctgggaggtgaagaagcagcgggcgggggtcctgtgggacgtgcccagcccgccgcccgtgggcaaggccgagctggaggacggggcctaccgcatcaagcagaagggcatcctcgggtacagccagatcggcgccggcgtctacaaggaggggaccttccacacgatgtggcacgtgacccggggcgccgtgctgatgcacaaggggaagcgcatcgagccctcctgggcggacgtcaagaaggacctgatcagctacggcgggggctggaagctcgagggcgagtggaaggagggggaggaggtccaggtgctggccctggagcccggcaagaacccccgggccgtccagaccaagcccggcctcttcaagaccaacacgggcaccatcggggccgtgtccctggacttcagccccggcacctccggcagccccatcgtggacaagaaggggaaggtcgtgggcctgtacgggaacggcgtggtcacccgctccggcacgtacgtgagcgccatcgcgcagaccgagaagtccatcgaggacaaccccgagatcgaggacgacatcttccggaagaagcgcctcaccatcatggacctgcaccccggggccggcaagaccaagcggtacctgcccgccatcgtgcgcgaggccatcaagcgggggctgcgcacgctcatcctggcgccgacccgggtcgtggccgccgagatggaggaggccctgcgcggcctccccatccgctaccagacccccgccatccgggtggagcacaccgggcgcgagatcgtcgacctgatgtgccacgcgacgttcaccatgcggctgctctcccccatccgcgtgccgaactacaacctgatcatcatggacgaggcccacttcaccgaccccgccagcatcgccgcccggggctacatctccacccgcgtggagatgggcgaggcggccgggatcttcatgacggccacgccgcccggcagccgggacccgttcccccagtccaacgcccccatcatggacgaggagcgcgagatccccgagcggagctggaactccgggcacgagtggatcaccgacttcaagggcaagaccgtctggttcgtgccgagcatcaaggccgggaacgacatcgcggcctgcctgcgcaagaacggcaagaaggtgatccagctctcccggaagacgttcgacagcgagtacatcaagacccgcaccaacgactgggacttcgtcgtgaccacggacatctccgagatgggcgccaacttcaaggccgagcgggtgatcgacccccgccggtgcatgaagcccgtcatcctgaccgacggggaggagcgcgtgatcctggcgggccccatgccggtgacccacagctccgccgcccagcggcgcgggcgggtcggccgcaaccccaagaacgagaacgaccagtacatctacatgggggagcccctcgagaacgacgaggactgcgcccactggaaggaggccaagatgctgctggacaacatcaacacccccgagggcatcatcccgagcatgttcgagcccgagcgcgagaaggtggacgcgatcgacggcgagtaccggctccgcggggaggcccggaagacgttcgtcgacctgatgcgccggggcgacctgcccgtgtggctcgcctaccgcgtggccgccgaggggatcaactacgcggaccggcgctggtgcttcgacggcgtcaagaacaaccagatcctggaggagaacgtggaggtggagatctggaccaaggagggggagcggaagaagctgaagccgcgctggctcgacgcccggatctactccgaccccctggccctgaaggagttcaaggagttcgccgccggccgcaagagcctcaccctgaacctgatcaccgagatgggccggctccccacgttcatgacccagaaggcgcgcaacgccctggacaacctggccgtcctccacaccgccgaggccggcgggcgggcctacaaccacgccctgtccgagctgcccgagaccctcgagacgctgctgctcctgaccctgctcgccaccgtgaccggcgggatcttcctgttcctgatgagcgggaaggggatcggcaagatgaccctcgggatgtgctgcatcatcacggcctccgtgctgctgtggtacgcgcagatccagccgcactggatcgccgccagcatcatcctcgagttcttcctgatcgtcctgctcatccccgagcccgagaagcagcgcacgccccaggacaaccagctgacctacgtggtgatcgccatcctgaccgtcgtggccgcgacgatggccaacgagatgggcttcctcgagaagaccaagaaggacttcgggctgggcagcatcgccatccagcagccggagtccaacatcctggacatcgacctccggcccgccagcgcctggaccctgtacgcggtggccaccacgttcatcacccccatgctgcgccactccatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcacgctcaccgccgccctgctgctcctggtggcccactacgcgatcatcgggcccggcctgcaggccaaggccacccgggaggcccagaagcgcgccgcggccggcatcatgaagaaccccaccgtcgacgggatcacggtgatcgacctcgacccgatcccctacgaccccaagttcgagaagcagctgggccaggtgatgctgctcgtcctgtgcgtgacccaggtgctgatgatgcggaccacctgggccctctgcgaggccctgacgctggccaccgggcccatctccaccctctgggagggcaacccggggcgcttctggaacaccacgatcgcggtcagcatggccaacatcttccgcggctcctacctggccggcgccgggctcctcttcagcatcatgaagaacaccgccaacacccggcgcggcaccgggaacacgggcgagaccctgggcgagaagtggaagaaccggctgaacgcgctcgggaagtccgagttccagatctacaagaagtccggcatccaggaggtggaccgcaccctggccaaggaggggatcaagcggggcgagaccgaccaccacgccgtgtcccgcgggagcgccaagctgcggtggttcgtcgagcgcaacctcgtgacgcccgagggcaaggtggtcgacctgggctgcgggcggggcgggtggtcctactactgcggcgggctgaagaacgtgaaggaggtgaagggcctcaccaagggcgggcccggccacgaggagcccatcccgatgagcacctacgggtggaacctggtccgcctgcagtccggcgtggacgtgttcttcacgccgcccgagaagtgcgacacgctcctgtgcgacatcggggagagcagccccaacccgaccgtcgaggcgggccggaccctgcgcgtgctcaacctggtggagaactggctgaacaacaacacccagttctgcatcaaggtcctcaacccctacatgccctccgtgatcgagaagatggaggccctgcagcggaagtacggcggggccctggtgcgcaacccgctgagccggaactccacccacgagatgtactgggtcagcaacgcctccggcaacatcgtgagctccgtgaacatgatcagccgcatgctcatcaaccggttcacgatgcgccacaagaaggccacctacgagcccgacgtcgacctggggtccggcacccggaacatcgggatcgagagcgagaagcccaacctggacatcatcggcaagcgcatcgagaagatcaagcaggagcacgagacctcctggcactacgaccaggaccacccctacaagacgtgggcgtaccacggcagctacgagaccaagcagaccgggtccgccagctccatggtgaacggcgtggtccgcctcctgaccaagccgtgggacgtgatccccatggtcacgcagatggccatgaccgacaccacccccttcgggcagcagcgggtgttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtccgcagcaacgccgcgctgggggccatcttcaccgacgagaacaagtggaagtccgcccgggaggccgtggaggacagcggcttctgggagctcgtgaacaaggagcgcaacctgcacctggaggggaagtgcgagacgtgcgtctacaacatgatgggcaagcgggagaagaagctcggggagttcggcaaggccaagggctcccgcgcgatctggtacatgtggctgggggcccggttcctggagttcgaggccctcggcttcctgaacgaggaccactggttcagccgcgagaacagcctgtccggggtggagggcgaggggctccacaagctgggctacatcctgcgggacgtgagcaagaaggagggcggggccatgtacgcggacgacaccgccggctgggacacccgcatcaccctcgaggacctgaagaacgaggagatggtcacgaaccacatggagggggagcacaagaagctggccgaggccatcttcaagctcacctaccagaacaaggtggtgcgggtccagcgccccacgccccggggcaccgtgatggacatcatctcccgccgggaccagcgcgggagcggccaggtggtcacgtacggcctgaacaccttcaccaacatggaggcccagctgatccggcagatggagggggagggcgtgttcaagtccatccagcacctcaccgtgacggaggagatcgcggtcaagaactggctggtgcgcgtggggcgcgagcggctgagccgcatggccatctccggcgacgactgcgtcgtgaagcccctcgacgaccggttcgccagcgccctgaccgccctgaacgacatgggcaaggtgcgcaaggacatccagcagtgggagccgtcccgggggtggaacgactggacccaggtccccttctgcagccaccacttccacgagctcatcatgaaggacggccgcgtgctggtggtcccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtgcccagccactgggtgccgacgtcccgcaccacctggagcatccacgccacccacgagtggatgaccacggaggacatgctgaccgtctggaaccgggtgtggatccaggagaacccctggatggaggacaagacccccgtggagagctgggaggagatcccctacctcggcaagcgcgaggaccagtggtgcgggtccctgatcggcctgaccagccgggccacgtgggcgaagaacatccagaccgccatcaaccaggtccgctccctcatcgggaacgaggagtacaccgactacatgccgagcatgaagcggttccgccgcgaggaggaggaggccggcgtgctgtggtga

SEQ ID NO: 9722 - RNA, 9876 nt, synthetic construct
  misc_feature 1..9876: note = derived and/or modified CDS sequence (opt1) from DENV-2__JN851122__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaagaccgggaacgacatcgccgcctgcctccggaagaacggcaagaaggtgatccagctgagccgcaagacgttcgactccgagtacatcaagacccggaccaacgactgggacttcgtggtcaccacggacatcagcgagatgggcgccaacttcaaggcggagcgcgtgatcgacccccggcgctgcatgaagcccgtgatcctgaccgacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcccactggaaggaggcgaagatgctgctcgacaacatcaacacccccgagggcatcatcccgtccatgttcgagcccgagcgggagaaggtcgacgccatcgacggcgagtaccgcctgcgcggggaggcccgcaagacgttcgtggacctgatgcggcgcggcgacctccccgtctggctggcctaccgggtggccgcggaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccacgttcatgacccagaaggccaagaacgccctggacaacctcgccgtgctgcacaccgcggaggccgggggccgggcctacaaccacgccctgagcgagctccccgagaccctggagacgctgctcctgctgaccctcctggccaccgtcaccgggggcatcttcctgttcctcatgtccggcaaggggatcggcaagatgaccctggggatgtgctgcatcatcacggcgagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggcggccacgatggccaacgagatgggcttcctggagaagaccaagaaggacttcgggctgggcagcatcaccacccagcagccggagagcaacatcctcgacatcgacctgcggcccgcctccgcctggacgctgtacgcggtcgccaccaccttcatcacccccatgctccgccacagcatcgagaactccagcgtgaacgtgtccctgacggccatcgccaaccaggccaccgtcctgatgggcctcgggaagggctggcccctgagcaagatggacatcggggtgccgctgctcgcgatcggctgctactcccaggtgaaccccatcaccctgaccgccgccctgctcctgctggtcacgcactacgccatcatcgggcccggcctccaggcgaaggccacccgggaggcccagaagcgcgccgccgcgggcatcatgaagaaccccaccgtggacgggatgaccgtgatcgacctggacccgatcccctacgaccccaagttcgagaagcagctgggccaggtcatgctcctggtgctgtgcgtgacgcaggtcctcatgatgcggaccacctgggccctgtgcgaggccctgaccctcgccacggggcccatcagcaccctgtgggagggcaacccggggcgcttctggaacaccaccatcgccgtgtccatggcgaacatcttccgcggcagctacctggccggcgccgggctcctgttctccatcatgaagaacacggccaacacccggcgcggcaccgggaacatcggcgagaccctgggcgagaagtggaagaaccggctcaacgccctgggcaagagcgagttccagatctacaagaagtccggcatccaggaggtggaccgcacgctggcgaaggaggggatcaagcggggcgagaccgaccaccacgccgtcagccgcgggtccgccaagctccggtggttcgtggagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacgtacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacgcagttctgcatcaaggtgctgaacccctacatgcccagcgtgatcgagaagatggaggcgctgcagcggaagtacggcggggccctggtccgcaacccgctctcccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctggggagcggcacgcggaacatcgggatcgagtccgagacccccaacctcgacatcatcggcaagcgcatcgagaagatcaagcaggagcacgagaccagctggcactacgaccaggaccacccctacaagacctgggcctaccacggctcctacgagacgaagcagaccgggagcgcgtccagcatggtgaacggcgtcgtgcgcctgctgaccaagccgtgggacgtgatccccatggtcacccagatggccatgacggacaccacccccttcgggcagcagcgggtgttcaaggagaaggtcgacacccgcacgcaggagcccaaggagggcaccaagaagctcatgaagatcaccgccgagtggctgtggaaggagctgggcaagaagaagaccccgcggatgtgcacgcgcgaggagttcacccggaaggtgcgctccaacgccgccctcggggcgatcttcaccgacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggccaagggcagccgcgccatctggtacatgtggctgggggcgcggttcctcgagttcgaggccctgggcttcctgaacgaggaccactggttctcccgcgagaacagcctcagcggggtggagggcgaggggctgcacaagctgggctacatcctccgggacgtctccaagaaggagggcggggccatgtacgccgacgacacggcgggctgggacacccgcatcaccctggaggacctgaagaacgaggagatggtgaccaaccacatggagggggagcacaagaagctcgccgaggccatcttcaagctgacgtaccagaacaaggtggtccgggtgcagcgccccacgccccggggcaccgtgatggacatcatcagccgccgggaccagcgcgggtccggccaggtcgtgacctacggcctgaacacgttcaccaacatggaggcccagctcatccggcagatggagggggagggcgtgttcaagagcatccagcagctgaccgtcaaggaggagatcgccgtgaagaactggctgatccgcgtggggcgcgagcggctctcccgcatggcgatcagcggcgacgactgcgtcgtgaagcccctggacgaccggttcgcctccgccctgaccgccctcaacgacatgggcaaggtgcgcaaggacatccagcagtgggagccgagccgggggtggaacgactggacgcaggtccccttctgctcccaccacttccacgagctgatcatgaaggacggccgcgtgctggtggtcccctgccggaaccaggacgagctcatcgggcgcgcccggatcagccagggcgcggggtggtccctgcgcgagaccgcctgcctgggcaagagctacgcccagatgtggtccctcatgtacttccaccggcgcgacctgcggctggccgccaacgcgatctgcagcgccgtgccctcccactgggtgccgaccagccgcaccacctggtccatccacgccacgcacgagtggatgaccaccgaggacatgctcaccgtctggaaccgggtgtggatccaggagaacccctggatggaggacaagacgcccgtggagagctgggaggagatcccctacctgggcaagcgcgaggaccagtggtgcgggagcctgatcggcctcacctcccgggccacctgggccaagaacatccagaccgcgatcaaccaggtccgcagcctgatcgggaacgaggagtacacggactacatgccgtccatgaagcggttccgccgcgaggaggaggaggccggcgtgctgtggtga

SEQ ID NO: 9723 - RNA, 9876 nt, synthetic construct
  misc_feature 1..9876: note = derived and/or modified CDS sequence (opt1) from DENV-2__JN851116__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcaccatcatggcggccatcctggcctacaccatcggcaccacctacttccagcgggtcctgatcttcatcctcctgaccgccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccatcctcgcggtggtctccgtgagccccctgctgctcacgtccagccagcagaaggccgactggatccccctggccctgaccatcaaggggctcaaccccaccgccatcttcctgaccacgctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcaccgtgtgctacgtcctgacggggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgaccatcctcatccggacgggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacccgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagacgaagcccgggctgttcaagaccaacaccggcaccatcggggccgtcagcctggacttctcccccggcacgagcggctcccccatcgtggacaagaaggggaaggtggtcggcctctacgggaacggcgtggtgacccggagcggcacctacgtctccgcgatcgcccagaccgagaagtccatcgaggacaaccccgagatcgaggacgacatcttccgcaagaagcggctgacgatcatggacctgcaccccggggccggcaagaccaagcgctacctgcccgccatcgtgcgggaggcgatcaagcgcgggctccggaccctgatcctggccccgacccgcgtggtcgccgccgagatggaggaggccctccgcggcctgcccatccggtaccagacgcccgcgatccgcgccgagcacaccgggcgggagatcgtggacctgatgtgccacgccaccttcaccatgcgcctcctgagccccatccgggtgccgaactacaacctgatcatcatggacgaggcccacttcacggaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgacggacttcaagggcaagaccgtgtggttcgtcccgtccatcaaggccgggaacgacatcgccgcctgcctccggaagaacggcaagaaggtgatccagctgagccgcaagaccttcgactccgagtacatcaagacccggacgaacgactgggacttcgtggtcaccaccgacatcagcgagatgggcgcgaacttcaaggccgagcgcgtgatcgacccccggcgctgcatgaagcccgtgatcctgaccgacggggaggagcgggtcatcctcgccggccccatgccggtgacgcactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgacgctgaacctcatcaccgagatgggccgcctgcccaccttcatgacccagaaggccaagaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacgtacgtggtcatcgcgatcctcaccgtggtggccgccaccatggccaacgagatgggcttcctggagaagaccaagaaggacttcgggctgggcagcatcacgacccagcagccggagagcaacatcctcgacatcgacctgcggcccgcctccgcgtggaccctgtacgccgtcgccaccacgttcatcacccccatgctccgccacagcatcgagaactccagcgtgaacgtgtccctgaccgccatcgccaaccaggcgaccgtcctgatgggcctcgggaagggctggcccctgagcaagatggacatcggggtgccgctgctcgccatcggctgctactcccaggtgaaccccatcacgctgaccgccgccctgctcctgctggtcgcgcactacgccatcatcgggcccggcctccaggccaaggccacccgggaggcccagaagcgcgcggccgccggcatcatgaagaaccccaccgtggacgggatgacggtgatcgacctggacccgatcccctacgaccccaagttcgagaagcagctgggccaggtcatgctcctggtgctgtgcgtgacccaggtcctcatgatgcggaccacctgggccctgtgcgaggccctgacgctcgcgaccgggcccatcagcaccctgtgggagggcaacccggggcgcttctggaacaccacgatcgccgtgtccatggccaacatcttccgcggcagctacctggccggcgccgggctcctgttctccatcatgaagaacaccgcgaacacccggcgcggcaccgggaacacgggcgagaccctgggcgagaagtggaagaaccggctcaacgccctgggcaagagcgagttccagatctacaagaagtccggcatccaggaggtggaccgcaccctggccaaggaggggatcaagcggggcgagaccgaccaccacgccgtcagccgcgggtccgcgaagctccggtggttcgtggagcgcaacctggtgacgcccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacacgctgctgtgcgacatcggggagtccagccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacccacgagatgtactgggtgtccaacgccagcggcaacatcgtgtccagcgtcaacatgatctcccgcatgctgatcaaccggttcacgatgcgccacaagaaggcgacctacgagcccgacgtggacctggggagcggcacccggaacatcgggatcgagtccgagacccccaacctcgacatcatcggcaagcgcatcgagaagatcaagcaggagcacgagacgagctggcactacgaccaggaccacccctacaagacctgggcctaccacggctcctacgagaccaagcagaccgggagcgcctccagcatggtgaacggcgtcgtgcgcctgctgacgaagccgtgggacgtgatccccatggtcacccagatggccatgaccgacaccacgcccttcgggcagcagcgggtgttcaaggagaaggtcgacacccgcacccaggagcccaaggagggcaccaagaagctcatgaagatcacggccgagtggctgtggaaggagctgggcaagaagaagaccccgcggatgtgcacccgcgaggagttcacccggaaggtgcgctccaacgcggccctcggggccatcttcacggacgagaacaagtggaagtccgcccgggaggccgtggaggactccggcttctgggagctggtcgacaaggagcgcaacctgcacctcgaggggaagtgcgagacctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacccgcatcacgctggaggacctgaagaacgaggagatggtgaccaaccacatggagggggagcacaagaagctcgccgaggccatcttcaagctgacctaccagaacaaggtggtccgggtgcagcgccccacgccccggggcacggtgatggacatcatcagccgccgggaccagcgcgggtccggccaggtcgtgacctacggcctgaacaccttcaccaacatggaggcgcagctcatccggcagatggagggggagggcgtgttcaagagcatccagcagctgacggtcaaggaggagatcgccgtgaagaactggctgatccgcgtggggcgcgagcggctctcccgcatggccatcagcggcgacgactgcgtcgtgaagcccctggacgaccggttcgcctccgccctgaccgcgctcaacgacatgggcaaggtgcgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtgccctcccactgggtgccgacgagccgcaccacctggtccatccacgccacccacgagtggatgaccacggaggacatgctcaccgtctggaaccgggtgtggatccaggagaacccctggatggaggacaagacccccgtggagagctgggaggagatcccctacctgggcaagcgcgaggaccagtggtgcgggagcctgatcggcctcacctcccgggcgacgtgggccaagaacatccagaccgccatcaaccaggtccgcagcctgatcgggaacgaggagtacaccgactacatgccgtccatgaagcggttccgccgcgaggaggaggaggccggcgtgctgtggtga

SEQ ID NO: 9724 - RNA, 9876 nt, synthetic construct
  misc_feature 1..9876: note = derived and/or modified CDS sequence (opt1) from DENV-2__GU370051__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctggagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgcgatcgcccagacggagaagtccatcgaggacaaccccgacatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaaggccgggaacgacatcgccgcctgcctccggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctgacggacggggaggagcgggtcatcctcgccggccccatgccggtgacccactccagcgccgcccagcgccgggggcgcgtgggccgcaaccccaagaacgacaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtcgccacgaccttcatcacccccatgctccgccacagcatcgagaactccagcgtgaacgtgtccctgaccgccatcgccaaccaggcgacggtcctgatgggcctcgggaagggctggcccctgagcaagatggacatcggggtgccgctgctcgccatcggctgctactcccaggtgaaccccatcaccctgaccgccgccctgctcctgctggtcgcgcactacgccatcatcgggcccggcctccaggccaaggccacccgggaggcccagaagcgcgcggccgccggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgcgaccgggcccatcagcaccctgtgggagggcaacccggggcgcttctggaacacgaccatcgccgtgtccatggccaacatcttccgcggcagctacctggccggcgccgggctcctgttctccatcatgaagaacaccgcgaacacccggcgcggcacggggaacaccggcgagaccctgggcgagaagtggaagaaccggctcaacgccctgggcaagagcgagttccagatctacaagaagtccggcatccaggaggtggaccgcaccctggccaaggaggggatcaagcggggcgagacggaccaccacgccgtcagccgcgggtccgcgaagctccggtggttcgtggagcgcaacctggtgacccccgagggcaaggtcgtggacctgggctgcgggcggggcgggtggagctactactgcggcgggctcaagaacgtgaaggaggtcaagggcctgaccaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggaccctccgcgtgctgaacctggtcgagaactggctcaacaacaacacccagttctgcatcaaggtgctgacgccctacatgcccagcgtgatcgagaagatggaggccctgcagcggaagtacggcggggccctggtccgcaacccgctctcccggaacagcacccacgagatgtactgggtgtccaacgccagcggcaacatcgtgtccagcgtcaacatgatctcccgcatgctgatcaaccggttcaccatgcgccacaagaaggcgacctacgagcccgacgtggacctggggagcggcacgcggaacatcgggatcgagtccgagacccccaacctcgacatcatcggcaagcgcatcggcaagatcaagcaggagcacgagaccagctggcactacgaccaggaccacccctacaagacctgggcctaccacgggtcctacgagacgaagcagaccggcagcgcctccagcatggtgaacggggtcgtgcgcctgctgaccaagccgtgggacgtgatccccatggtcacccagatggccatgacggacaccacccccttcggccagcagcgggtgttcaaggagaaggtcgacacccgcacgcaggagcccaaggagggcaccaagaagctcatgaagatcaccgccgagtggctgtggaaggagctggggaagaagaagaccccgcggatgtgcacgcgcgaggagttcacccggaaggtgcgctccaacgcggccctcggcgccatcttcaccgacgagaacaagtggaagtccgcccgggaggccgtggaggactccgggttctgggagctggtcgacaaggagcgcaacctgcacctcgagggcaagtgcgagacctgcgtgtacaacatgatggggaagcgggagaagaagctgggcgagttcggcaaggcgaaggggagccgcgccatctggtacatgtggctgggcgcccggttcctcgagttcgaggccctggggttcctgaacgaggaccactggttctcccgcgagaacagcctcagcggcgtggagggggagggcctgcacaagctgggctacatcctccgggacgtctccaagaaggagggcggggcgatgtacgccgacgacacggccgggtgggacacccgcatcaccctggaggacctgaagaacgaggagatggtgaccaaccacatggagggcgagcacaagaagctcgccgaggccatcttcaagctgacgtaccagaacaaggtggtccgggtgcagcgccccacgccccgggggaccgtgatggacatcatcagccgccgggaccagcgcggctccggccaggtcgtgacctacgggctgaacacgttcaccaacatggaggcgcagctcatccggcagatggagggcgagggggtgttcaagagcatccagcagctgaccgtcaaggaggagatcgccgtggagaactggctgatgcgcgtgggccgcgagcggctctcccgcatggccatcagcggcgacgactgcgtcgtgaagcccctggacgaccggttcgcctccgccctgaccgcgctcaacgacatggggaaggtgcgcaaggacatccagcagtgggagccgagccggggctggaacgactggacgcaggtccccttctgctcccaccacttccacgagctgatcatgaaggacgggcgcgtgctggtggtcccctgccggaaccaggacgagctcatcggccgcgcccggatcagccagggggccggctggtccctgcgcgagaccgcctgcctgggcaagagctacgcccagatgtggtccctcatgtacttccaccggcgcgacctgcggctggcggccaacgccatctgcagcgccgtgccctcccactgggtgccgaccagccgcaccacctggtccatccacgccacgcacgagtggatgaccaccgaggacatgctcaccgtctggaaccgggtgtggatccaggagaacccctggatggaggacaagacgcccgtggagagctgggaggagatcccctacctggggaagcgcgaggaccagtggtgcggcagcctgatcgggctcacctcccgggcgacctgggccaagaacatccagaccgccatcaaccaggtccgcagcctgatcggcaacgaggagtacacggactacatgccgtccatgaagcggttccgccgcgaggaggaggaggccggggtgctgtggtga

SEQ ID NO: 9725 - RNA, 9876 nt, synthetic construct
  misc_feature 1..9876: note = derived and/or modified CDS sequence (opt1) from DENV-2__EU359009__SS-prME
  source 1..9876: mol_type = other RNA
accgccgggatcatcatcatgatgatccccaccgtgatggccttccacctgaccacccggaacggggagccccacatgatcgtgagccggcaggagaagggcaagagcctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgagcagcgagggcgcctggaagcacgcccagcggatcgagacctgggtcctccgccacccggggttcacgatcatggcggccatcctggcctacaccatcggcaccacctacttccagcgggtgctgatcttcatcctcctgacggccatcgcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaagatcgtgcagcccgagaacctcgagtacaccatcgtgatcacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccgcaccggcctggacttcaacgagatggtcctcctgcagatggagaacaaggcctggctggtgcaccggcagtggttcctcgacctgcccttcccctggctgccgggcgcggacacccaggggtccaactggatccagaaggagaccctcgtgacgttcaagaacccccacgccaagaagcaggacgtcgtggtcctgggcagccaggagggggccatgcacaccgccctgaccggcgccaccgagatccagatgagctccgggaacctcctgttcacgggccacctgaagtgccgcctccggatggacaagctgcagctgaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctcgagaagcggcacgtgctgggccgcctgatcacggtcaacccgatcgtgaccgagaaggactcccccgtgaacatcgaggccgagccgcccttcggggacagctacatcatcatcggcgtcgagccggggcagctcaagctgtcctggttcaagaagggcagctccatcgggcagatgttcgagaccaccatgcgcggcgccaagcggatggccatcctgggcgacacggcctgggacttcgggagcctcggcggggtgttcacctccatcggcaaggcgctgcaccaggtgttcggggccatctacggcgccgccttcagcggcgtctcctggaccatgaagatcctgatcggggtggtgatcacctggatcggcatgaacagccgctccacgagcctctccgtcagcctggtgctggtgggggtcgtgaccctgtacctcggcgtgatggtccaggcggactccgggtgcgtggtgagctggaagaacaaggagctgaagtgcggcagcggcatcttcatcaccgacaacgtccacacctggacggagcagtacaagttccagcccgagtcccccagcaagctggcctccgccatccagaaggcccacgaggaggggatctgcggcatccggagcgtgacccgcctcgagaacctgatgtggaagcagatcacccccgagctgaaccacatcctctccgagaacgaggtgaagctgaccatcatgacgggggacatcaagggcatcatgcaggccgggaagcggagcctgcgcccgcagcccaccgagctcaagtactcctggaaggcgtggggcaaggccaagatgctgagcaccgagctgcacaaccacaccttcctcatcgacggccccgagacggccgagtgcccgaacaccaaccgggcctggaactccctggaggtcgaggactacgggttcggcgtgttcaccaccaacatctggctgaagctcaaggagcgccaggacgtgttctgcgacagcaagctgatgtccgccgcgatcaaggacaaccgggccgtccacgccgacatggggtactggatcgagagcgccctgaacgacacgtggaagatcgagaaggcctccttcatcgaggtcaagagctgccactggcccaagtcccacaccctctggagcaacggcgtgctggagtccgagatgatcatccccaagaacttcgcgggccccgtgagccagcacaactaccgcccggggtaccacacccagaccgccggcccctggcacctggggcggctcgagatggacttcgacttctgcgagggcaccacggtggtggtcaccgaggactgcgggaaccgcggccccagcctgcggaccaccacggcctccggcaagctgatcaccgagtggtgctgccgcagctgcaccctgccgcccctgcggtaccgcggggaggacggctgctggtacgggatggagatccggcccctgaaggagaaggaggagaacctcgtgaactccctggtgaccgccggccacgggcagatcgacaacttcagcctgggcgtcctcggcatggcgctgttcctggaggagatgctccgcacgcgggtggggaccaagcacgccatcctgctggtggccgtctccttcgtgaccctcatcaccggcaacatgagcttccgcgacctggggcgcgtgatggtcatggtgggcgccacgatgaccgacgacatcgggatgggcgtgacctacctggccctcctggcggccttcaaggtccggcccaccttcgccgccggcctgctcctgcgcaagctgacgtccaaggagctcatgatgaccaccatcgggatcgtgctgctgagccagtccaccatccccgagacgatcctcgagctgaccgacgccctggcgctcggcatgatggtgctgaagatcgtccggaacatggagaagtaccagctggccgtgaccatcatggccatcctctgcgtccccaacgccgtgatcctgcagaacgcctggaaggtgagctgcaccacgctggcggtcgtgtccgtgagccccctcctgctgacctccagccagcagaaggccgactggatccccctcgccctgaccatcaaggggctgaaccccaccgccatcttcctcacgaccctgtcccgcaccagcaagaagcggtcctggccgctgaacgaggcgatcatggccgtcggcatggtgagcatcctcgcctccagcctgctgaagaacgacatccccatgaccggccccctcgtggccgggggcctgctgacggtctgctacgtgctcaccgggcgcagcgccgacctggagctggagcgggcggccgacgtgcgctgggaggagcaggccgagatctccggcagctcccccatcctcagcatcaccatctccgaggacgggagcatgtccatcaagaacgaggaggaggagcagaccctgacgatcctgatccggaccggcctcctggtcatcagcggcctgttcccggtgtccatccccatcaccgccgccgcgtggtacctctgggaggtgaagaagcagcgcgccggggtcctgtgggacgtgccctccccgccgcccgtgggcaaggccgagctggaggacggggcctaccggatcaagcagaagggcatcctcgggtactcccagatcggcgccggcgtctacaaggaggggaccttccacaccatgtggcacgtgacgcgcggcgcggtgctgatgcacaaggggaagcggatcgagcccagctgggccgacgtcaagaaggacctgatctcctacggcgggggctggaagctcgagggcgagtggaaggagggggaggaggtccaggtgctggccctggagcccggcaagaacccccgcgccgtccagaccaagcccggcctcttcaagaccaacaccggcacgatcggggccgtgagcctggacttctcccccggcaccagcggctcccccatcgtggacaagaaggggaaggtcgtgggcctgtacgggaacggcgtggtcacccggagcggcacctacgtgtccgcgatcgcccagacggagaagtccatcgaggacaaccccgagatcgaggacgacatcttccgcaagaagcggctcaccatcatggacctgcaccccggggccggcaagaccaagcgctacctgcccgccatcgtgcgggaggcgatcaagcgcgggctgcggaccctcatcctggccccgacgcgcgtcgtggccgccgagatggaggaggccctgcgcggcctccccatccggtaccagacccccgcgatccgcgccgagcacaccgggcgggagatcgtggacctgatgtgccacgccaccttcacgatgcgcctgctcagccccatccgggtcccgaactacaacctgatcatcatggacgaggcccacttcaccgaccccgcctccatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctgcggaagaacggcaagaaggtgatccagctcagccgcaagaccttcgacacggagtacatcaagacccggaccaacgactgggacttcgtcgtgaccacggacatctccgagatgggcgcgaacttcaaggccgagcgcgtgatcgacccccggcgctgcatgaagcccgtcatcctgaccgacggggaggagcgggtgatcctggccggccccatgccggtgacccacagctccgccgcccagcgccgggggcgcgtcggccgcaaccccaagaacgagaacgaccagtacatctacatgggggagcccctcgagaacgacgaggactgcgcgcactggaaggaggccaagatgctgctggacaacatcaacacccccgagggcatcatcccgagcatgttcgagcccgagcgggagaaggtggacgccatcgacggcgagtaccgcctccgcggggaggcccgcaagacgttcgtggacctgatgcggcgcggcgacctgcccgtctggctcgcctaccgggtggcggccgaggggatcaactacgccgaccgccggtggtgcttcgacggcgtcaagaacaaccagatcctggaggagaacgtggaggtggagatctggaccaaggagggggagcgcaagaagctgaagccgcggtggctcgacgcccgcatctactccgaccccctggccctgaaggagttcaaggagttcgcggccggccgcaagagcctcaccctgaacctgatcaccgagatgggccgcctccccacgttcatgacccagaaggcccggaacgccctggacaacctggcggtcctccacaccgccgaggccgggggccgcgcctacaaccacgccctgtccgagctgcccgagaccctcgagacgctgctgctcctgaccctgctcgcgaccgtgaccgggggcatcttcctgttcctgatgagcggcaaggggatcggcaagatgaccctcgggatgtgctgcatcatcacggcctccatcctgctgtggtacgcccagatccagccgcactggatcgccgccagcatcatcctcgagttcttcctgatcgtgctgctcatccccgagcccgagaagcagcggacgccccaggacaaccagctgacctacgtcgtgatcgcgatcctgaccgtggtcgccgccacgatggccaacgagatgggcttcctcgagaagaccaagaaggacttcgggctgggctccatcaccacccagcagccggagagcaacatcctggacatcgacctccgccccgccagcgcgtggacgctgtacgccgtggccaccaccttcatcacccccatgctgcggcactccatcgagaacagctccgtgaacgtcagcctcacggccatcgccaaccaggcgaccgtgctgatgggcctggggaagggctggcccctctccaagatggacatcggggtgccgctgctggccatcggctgctacagccaggtcaaccccatcaccctcaccgccgccctgctgctcctggtggcgcactacgccatcatcgggcccggcctgcaggccaaggccacgcgcgaggcccagaagcgggcggccgccggcatcatgaagaaccccaccgtggacgggatcaccgtcatcgacctcgacccgatcccctacgaccccaagttcgagaagcagctgggccaggtgatgctgctcgtgctgtgcgtcacccaggtgctgatgatgcgcacgacctgggccctctgcgaggccctgaccctggcgaccgggcccatctccacgctctgggagggcaacccggggcgcttctggaacaccaccatcgccgtgagcatggccaacatcttccggggctcctacctggccggcgccgggctcctcttcagcatcatgaagaacaccgcgaacacgcgccggggcaccgggaacaccggcgagaccctgggcgagaagtggaagaaccgcctgaacgccctcgggaagtccgagttccagatctacaagaagtccggcatccaggaggtcgaccggacgctggccaaggaggggatcaagcgcggcgagaccgaccaccacgccgtgtcccgggggagcgcgaagctgcgctggttcgtggagcggaacctcgtcacccccgagggcaaggtggtggacctgggctgcgggcgcggcgggtggtcctactactgcggcgggctgaagaacgtcaaggaggtgaagggcctcaccaagggcgggcccggccacgaggagcccatcccgatgagcacgtacgggtggaacctggtgcggctgcagtccggcgtcgacgtgttcttcacgccgcccgagaagtgcgacaccctcctgtgcgacatcggggagagctcccccaacccgaccgtggaggccggccgcaccctgcgggtcctcaacctggtggagaactggctgaacaacaacacgcagttctgcatcaaggtgctcaacccctacatgcccagcgtcatcgagaagatggaggccctgcagcgcaagtacggcggggccctggtgcggaacccgctgagccgcaactccacccacgagatgtactgggtgagcaacgcctccggcaacatcgtcagctccgtgaacatgatcagccggatgctcatcaaccgcttcaccatgcggcacaagaaggcgacctacgagcccgacgtggacctggggtccggcacgcgcaacatcgggatcgagagcgagacccccaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtcaacggcgtggtgcggctcctgaccaagccgtgggacgtcatccccatggtgacccagatggccatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggagcaacgcggccctgggggccatcttcaccgacgagaacaagtggaagtccgcccgcgaggccgtcgaggacagcggcttctgggagctcgtggacaaggagcggaacctgcacctggaggggaagtgcgagacctgcgtgtacaacatgatgggcaagcgcgagaagaagctcggggagttcggcaaggcgaagggctcccgggccatctggtacatgtggctgggggcccgcttcctggagttcgaggccctcggcttcctgaacgaggaccactggttcagccgggagaactccctgagcggggtcgagggcgaggggctccacaagctgggctacatcctgcgcgacgtgagcaagaaggagggcggggcgatgtacgccgacgacacggccggctgggacacccggatcaccctcgaggacctgaagaacgaggagatggtgaccaaccacatggagggggagcacaagaagctggccgaggccatcttccgcctcacgtaccagaacaaggtcgtgcgggtgcagcgccccacgccccggggcaccgtcatggacatcatctcccgccgggaccagcgcgggagcggccaggtggtgacctacggcctgaacaccttcaccaacatggaggcgcagctgatccgccagatggagggggagggcgtcttcaagtccatccagcacctcaccgtgaccgaggagatcgccgtgaagaactggctggtccgggtggggcgcgagcggctgagccgcatggccatctccggcgacgactgcgtggtcaagcccctcgacgaccggttcgccagcgccctgacggcgctgaacgacatgggcaaggtgcgcaaggacatccagcagtgggagccgtcccgggggtggaacgactggacccaggtgcccttctgcagccaccacttccacgagctcatcatgaaggacggccgcgtcctggtggtgccctgccggaaccaggacgagctgatcgggcgcgcccggatctcccagggcgccgggtggagcctccgcgagaccgcctgcctgggcaagtcctacgcccagatgtggagcctgatgtacttccaccggcgcgacctccggctggcggccaacgccatctgctccgccgtccccagccactgggtgccgacctcccgcaccacgtggagcatccacgccacccacgagtggatgaccaccgaggacatgctgacggtgtggaaccgggtctggatccaggagaacccctggatggaggacaagacccccgtggagtcctgggaggagatcccctacctcggcaagcgcgaggaccagtggtgcgggagcctgatcggcctgaccagccgggcgacctgggccaagaacatccagacggccatcaaccaggtgcgctccctcatcgggaacgaggagtacaccgactacatgccgagcatgaagcgcttccggcgcgaggaggaggaggccggcgtcctgtggtga

SEQ ID NO: 9726 - RNA, 9876 nt, synthetic construct
  misc_feature 1..9876: note = derived and/or modified CDS sequence (opt1) from DENV-2__KC131142__SS-prME
  source 1..9876: mol_type = other RNA
accgcgggcatcatcatcatggtgatccccaccgtgatggccttccacctgaccacccggaacggggagccccacatgatcgtgagccggcaggagaagggcaagagcctcctgttcaagaccgagaacgggctgaacatgtgcaccctcatggcgatggacctgggcgagctgtgcgaggacaccatcacctacaactgccccctcctgcgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcccagcggatcgagacctgggtcctgcgccacccggggttcaccatcatggcggccatcctggcctacaccatcggcaccacctacttccagcgggtgctcatcttcatcctgctgacggccatcgcgccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcaccccgccaccctccgcaagtactgcatcgaggccaagctgaccaacacgaccaccgcgagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaagatcgtgcagcccgagaacctggagtacaccatcgtgatcacgccccactccggcgaggagaacgccgtcgggaacgacacgggcaagcacgggaaggagatcaaggtgaccccgcagagctccatcaccgaggccgagctgaccggctacgggaccgtgacgatggagtgcagcccccgcaccggcctcgacttcaacgagatggtcctgctgcagatggagaacaaggcctggctcgtgcaccggcagtggttcctggacctgcccctcccctggctgccgggcgcggacacccaggggtccaactggatccagaaggagaccctggtgacgttcaagaacccccacgccaagaagcaggacgtcgtggtcctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctggagaagcggcacgtgctcggccgcctgatcacggtcaacccgatcgtgaccgagaaggactcccccgtgaacatcgaggccgagccgcccttcggggacagctacatcatcatcggcgtcgagccggggcagctgaagctctcctggttcaagaagggcagctccatcgggcagatgttcgagaccaccatgcgcggcgccaagcggatggccatcctgggcgacacggcctgggacttcgggagcctgggcggggtgttcacctccatcggcaaggcgctccaccaggtgttcggggccatctacggcgccgccttcagcggcgtctcctggaccatgaagatcctgatcggggtggtgatcacctggatcggcatgaacagccgctccacgagcctgtccgtcagcctggtgctcgtgggggtcgtgaccctgtacctgggcgtgatggtccaggcggactccgggtgcgtggtgagctggaagaacaaggagctcaagtgcggcagcggcatcttcatcaccgacaacgtccacacctggacggagcagtacaagttccagcccgagtcccccagcaagctggcctccgccatccagaaggcccacgaggaggggatctgcggcatccggagcgtgacccgcctggagaacctcatgtggaagcagatcacccccgagctgaaccacatcctgtccgagaacgaggtgaagctcaccatcatgacgggggacatcaagggcatcatgcaggccgggaagcggagcctgcgcccgcagcccaccgagctgaagtactcctggaaggcgtggggcaaggccaagatgctcagcaccgagctgcacaaccacaccttcctgatcgacggccccgagacggccgagtgcccgaacaccaaccgggcctggaactccctcgaggtcgaggactacgggttcggcgtgttcaccaccaacatctggctgaagctgaaggagcgccaggacgtgttctgcgacagcaagctcatgtccgccgcgatcaaggacaaccgggccgtccacgccgacatggggtactggatcgagagcgccctgaacgacacgtggaagatcgagaaggcctccttcatcgaggtcaagagctgccactggcccaagtcccacaccctgtggagcaacggcgtgctcgagtccgagatgatcatccccaagaacttcgcgggccccgtgagccagcacaactaccgcccggggtaccacacccagaccgccggcccctggcacctggggcggctggagatggacttcgacttctgcgagggcaccacggtggtggtcaccgaggactgcgggaaccgcggccccagcctccggaccaccacggcctccggcaagctgatcaccgagtggtgctgccgcagctgcaccctgcccccgctccggtaccgcggggaggacggctgctggtacgggatggagatccggcccctgaaggagaaggaggagaacctggtgaactccctcgtgaccgccggccacgggcagatcgacaacttcagcctgggcgtcctgggcatggccctgttcctggaggagatgctgcgcacgcgggtggggaccaagcacgccatcctcctggtggccgtctccttcgtgaccctgatcaccggcaacatgagcttccgcgacctcgggcgcgtgatggtcatggtgggcgccacgatgaccgacgacatcgggatgggcgtgacctacctggccctgctcgcggccttcaaggtccggcccaccttcgccgccggcctgctgctccgcaagctgacgtccaaggagctgatgatgaccaccatcgggatcgtgctcctgagccagtccaccatccccgagacgatcctggagctcaccgacgccctggcgctgggcatgatggtgctcaagatcgtccggaacatggagaagtaccagctggccgtgaccatcatggccatcctgtgcgtcccgaacgccgtgatcctccagaacgcctggaaggtgagctgcaccacgctggcggtcgtgtccgtgagccccctgctcctgacctccagccagcagaaggccgactggatccccctggccctcaccatcaaggggctgaaccccaccgccatcttcctgacgaccctctcccgcaccagcaagaagcggtcctggccgctgaacgaggcgatcatggccgtcggcatggtgagcatcctggcctccagcctcctgaagaacgacatccccatgaccggccccctggtggccgggggcctcctgacggtctgctacgtgctgaccgggcgcagcgccgacctcgagctggagcgggcggccgacgtgcgctgggaggagcaggccgagatctccggcagctcccccatcctgagcatcaccatctccgaggacgggagcatgtccatcaagaacgaggaggaggagcagaccctcacgatcctgatccggaccggcctgctcgtcatcagcggcctgttcccggtgtccatccccatcaccgccgccgcgtggtacctgtgggaggtgaagaagcagcgcgccggggtcctctgggacgtgcccagcccgccgcccgtgggcaaggccgagctggaggacggggcctaccggatcaagcagaagggcatcctggggtactcccagatcggcgccggcgtctacaaggaggggaccttccacaccatgtggcacgtgacgcgcggcgcggtgctcatgcacaaggggaagcggatcgagcccagctgggccgacgtcaagaaggacctgatctcctacggcgggggctggaagctggagggcgagtggaaggagggggaggaggtccaggtgctcgccctggagcccggcaagaacccccgcgccgtccagaccaagcccgggctgttcaagaccaacaccggcacgatcggggccgtgagcctcgacttctcccccggcaccagcggctcccccatcgtggacaagaaggggaaggtcgtgggcctgtacgggaacggcgtggtcacccggagcggcacctacgtgtccgcgatcgcccagacggagaagtccatcgaggacaacctggagatcgaggacgacatcttccgcaagaagcggctgaccgtgatggacctccaccccggggccggcaagaccaagcgctacctgcccgccatcgtccgggaggcgatcaagcgcgggctgcggaccctcatcctggcccccacgcgcgtggtggccgccgagatggaggaggccctgcgcggcctcccgatccggtaccagacccccgcgatccgcgccgagcacaccgggcgggagatcgtcgacctgatgtgccacgccaccttcacgatgcgcctgctcagccccatccgggtgcccaactacaacctgatcatcatggacgaggcccacttcaccgacccggcctccatcgcggcccgcggctacatcagcacccgggtggagatgggcgaggccgccgggatcttcatgaccgccacgccgcccggctcccgcgaccccttcccgcagagcaacgcgcccatcatggacgaggagcgggagatccccgagcgctcctggaacagcgggcacgagtgggtcaccgacttcaagggcaagaccgtgtggttcgtgccctccatcaaggccgggaacgacatcgccgcctgcctgcggaagaacggcaagaaggtcatccagctcagccgcaagaccttcgacacggagtacatcaagacccggaccaacgactgggacttcgtggtgaccacggacatctccgagatgggcgcgaacttcaaggccgagcgcgtcatcgacccgcggcgctgcatgaagcccgtgatcctgaccgacggggaggagcgggtgatcctggccggccccatgcccgtcacccacagctccgccgcccagcgccgggggcgcgtgggccgcaacccgaagaacgagaacgaccagtacatctacatgggggagcccctcgagaacgacgaggactgcgcgcactggaaggaggccaagatgctgctggacaacatcaacacccccgagggcatcatccccagcatgttcgagccggagcgggagaaggtggacgccatcgacggcgagtaccgcctccgcggggaggcccgcaagacgttcgtcgacctgatgcggcgcggcgacctgcccgtgtggctcgcctaccgggtcgcggccgaggggatcaactacgccgaccgccggtggtgcttcgacggcgtgaagaacaaccagatcctggaggagaacgtggaggtcgagatctggaccaaggagggggagcgcaagaagctgaagccccggtggctcgacgcccgcatctactccgacccgctggccctgaaggagttcaaggagttcgcggccggccgcaagagcctcaccctgaacctgatcaccgagatgggccgcctccccacgttcatgacccagaaggcccggaacgccctggacaacctggcggtgctccacaccgccgaggccgggggccgcgcctacaaccacgccctgtccgagctgcccgagaccctcgagacgctgctgctcctgaccctgctcgcgaccgtgaccgggggcatcttcctgttcctgatgagcggcaaggggatcggcaagatgaccctcgggatgtgctgcatcatcacggcctccatcctgctgtggtacgcccagatccagccccactggatcgccgccagcatcatcctcgagttcttcctgatcgtcctgctcatcccggagcccgagaagcagcggacgccccaggacaaccagctgacctacgtggtgatcgcgatcctgaccgtcgtggccgccacgatggccaacgagatgggcttcctcgagaagaccaagaaggacttcgggctgggctccatcaccacccagcagcccgagagcaacatcctggacatcgacctccgcccggccagcgcgtggacgctgtacgccgtggccaccaccttcatcacccccatgctgcggcactccatcgagaacagctccgtcaacgtgagcctcacggccatcgccaaccaggcgaccgtgctgatgggcctggggaagggctggcccctctccaagatggacatcggggtccccctgctggccatcggctgctacagccaggtgaacccgatcaccctcaccgccgccctgctgctcctggtggcgcactacgccatcatcgggcccggcctgcaggccaaggccacgcgcgaggcccagaagcgggcggccgccggcatcatgaagaaccccaccgtcgacgggatcaccgtgatcgacctcgaccccatcccgtacgaccccaagttcgagaagcagctgggccaggtgatgctgctcgtcctgtgcgtgacccaggtgctgatgatgcgcacgacctgggccctctgcgaggccctgaccctggcgaccgggcccatctccacgctctgggagggcaaccccgggcgcttctggaacaccaccatcgccgtcagcatggccaacatcttccggggctcctacctggccggcgccgggctcctcttcagcatcatgaagaacaccgcgaacacgcgccggggcaccgggaacaccggcgagaccctgggcgagaagtggaagaaccgcctgaacgccctcgggaagtccgagttccagatctacaagaagtccggcatccaggaggtggaccggacgctggccaaggaggggatcaagcgcggcgagaccgaccaccacgccgtgtcccgggggagcgcgaagctgcgctggttcgtcgagcggaacctcgtgaccccggagggcaaggtggtcgacctgggctgcgggcgcggcgggtggtcctactactgcggcgggctgaagaacgtgaaggaggtgaagggcctcaccaagggcgggcccggccacgaggagcccatccccatgagcacgtacgggtggaacctggtccggctgcagtccggcgtggacgtgttcttcaccccgcccgagaagtgcgacaccctcctgtgcgacatcggggagagctcccccaaccccaccgtcgaggccggccgcaccctgcgggtgctcaacctggtggagaactggctgaacaacaacacgcagttctgcatcaaggtcctgaacccgtacatgcccagcgtgatcgagaagatggaggccctccagcgcaagtacggcggggccctggtgcggaaccccctgagccgcaactccacccacgagatgtactgggtcagcaacgcctccggcaacatcgtgagctccgtgaacatgatcagccggatgctcatcaaccgcttcaccatgcggcacaagaaggcgacctacgagccggacgtcgacctggggtccggcacgcgcaacatcgggatcgagagcgagacccccaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtggtcaagctcctgaccaagccctgggacgtgatcccgatggtgacccagatggccatgacggacaccacccccttcgggcagcagcgggtcttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtccgcagcaacgcggccctgggggccatcttcaccgacgagaacaagtggaagtccgcccggggcgccgtggaggacagcgggttctgggagctcgtggacaaggagcgcaacctgcacctggagggcaagtgcgagacctgcgtctacaacatgatggggaagcgggagaagaagctcggcgagttcggcaaggcgaaggggtcccgcgccatctggtacatgtggctgggcgcccggttcctggagttcgaggccctcgggttcctgaacgaggaccactggttcagccgcgagaactccctgagcggcgtggagggggagggcctccacaagctgggctacatcctgcgggacgtgagcaagaaggagggcggggcgatgtacgccgacgacacggccgggtgggacacccgcatcaccctcgaggacctgaagaacgaggagatggtcaccaaccacatggagggcgtgcacaagaagctggccgaggccatcttccggctcacgtaccagaacaaggtggtccgcgtgcagcggccgacgccccgggggaccgtgatggacatcatctcccggcgcgaccagcggggcagcggccaggtcgtgacctacgggctgaacacgttcaccaacatggaggcgcagctgatccgccagatggagggcgagggggtgttcaagtccatccagcacctcaccgtcaccgaggagatcgccgtgaagaactggctggtgcgcgtcggccgggagcgcctgagccggatggccatctccggcgacgactgcgtggtgaagcccctcgacgaccgcttcgccagcgccctgacggcgctgaacgacatggggaaggtccggaaggacatccagcagtgggagccctcccgcggctggaacgactggacccaggtgccgttctgcagccaccacttccacgagctcatcatgaaggacgggcgggtgctggtcgtgccctgccgcaaccaggacgagctgatcggccgggcccgcatctcccagggggccggctggagcctccgggagaccgcctgcctgggcaagtcctacgcccagatgtggagcctgatgtacttccaccgccgggacctccgcctggcggccaacgccatctgctccgccgtgcccagccactgggtccccacctcccggaccacgtggagcatccacgccacccacgagtggatgaccaccgaggacatgctgacggtgtggaaccgcgtgtggatccaggagaacccgtggatggaggacaagacccccgtcgagtcctgggaggagatcccctacctcgggaagcgggaggaccagtggtgcggcagcctgatcgggctgaccagccgcgcgacctgggccaagaacatccagacggccatcaaccaggtgcggtccctcatcggcaacgaggagtacaccgactacatgcccagcatgaagcgcttccgccgggaggaggaggaggccggggtgctgtggtga

SEQ ID NO: 9727 - RNA, 9876 nt, synthetic construct
  misc_feature 1..9876: note = derived and/or modified CDS sequence (opt1) from DENV-2__AY858035__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgaccgccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtggtcgtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggccggccacgggcagatcgacaacttcagcctcggcgtgctgggcatggccctgttcctcgaggagatgctgcgcacccgggtggggaccaagcacgcgatcctgctcgtcgccgtgtccttcgtgaccctgatcacgggcaacatgagcttccgcgacctggggcgcgtcatggtgatggtgggcgccaccatgaccgacgacatcgggatgggcgtcacctacctcgccctgctggccgcgttcaaggtgcggcccacgttcgccgccggcctcctgctgcgcaagctcacctccaaggagctgatgatgaccaccatcgggatcgtgctgctcagccagtccacgatccccgagaccatcctggagctgaccgacgccctcgccctgggcatgatggtcctgaagatcgtgcggaacatggagaagtaccagctcgcggtcaccatcatggccatcctgtgcgtgccgaacgccgtgatcctgcagaacgcctggaaggtcagctgcacgaccctcgccgtggtgtccgtcagccccctgctgctcacctccagccagcagaaggcggactggatccccctggccctgaccatcaaggggctcaaccccacggccatcttcctgaccaccctgtcccgcaccagcaagaagcggtcctggccgctcaacgaggccatcatggcggtgggcatggtgagcatcctggcctccagcctgctcaagaacgacatccccatgacgggccccctggtcgccgggggcctgctcaccgtgtgctacgtgctgaccgggcgcagcgccgacctggagctcgagcgggccgcggacgtccgctgggaggagcaggccgagatctccggcagctcccccatcctgagcatcaccatctccgaggacgggagcatgtccatcaagaacgaggaggaggagcagacgctgaccatcctcatccggaccggcctgctggtggtgagcggcctcttcccggtctccatccccatcaccgccgccgcctggtacctgtgggaggtgaagaagcagcgcgcgggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacacgatgtggcacgtcacccgcggcgccgtgctgatgcacaaggggaagcggatcgagcccagctgggcggacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacacgggcaccatcggggccgtcagcctggacttctcccccggcaccagcggctcccccatcgtggacaagaaggggaaggtggtcggcctctacgggaacggcgtggtgacccggagcggcacgtacgtctccgccatcgcgcagaccgagaagtccatcgaggacaaccccgagatcgaggacgacatcttccgcaagaagcggctgaccatcatggacctgcaccccggggccggcaagaccaagcgctacctgcccgccatcgtgcgggaggccatcaagcgcgggctccggacgctgatcctggcgccgacccgcgtggtcgccgccgagatggaggaggccctccgcggcctgcccatccggtaccagacccccgccatccgcgcggagcacaccgggcgggagatcgtggacctgatgtgccacgccacgttcaccatgcgcctcctgagccccatccgggtgccgaactacaacctgatcatcatggacgaggcccacttcaccgaccccgcctccatcgccgcgcgcggctacatcagcacccgggtcgagatgggcgaggccgccgggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctccggaagaacggcaagaaggtgatccagctgagccgcaagacgttcgactccgagtacatcaagacccggaccaacgactgggacttcgtggtcaccacggacatcagcgagatgggcgccaacttcaaggcggagcgcgtgatcgacccccggcgctgcatgaagcccgtgatcctgaccgacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcccactggaaggaggcgaagatgctgctcgacaacatcaacacccccgagggcatcatcccgtccatgttcgagcccgagcgggagaaggtcgacgccatcgacggcgagtaccgcctgcgcggggaggcccgcaagacgttcgtggacctgatgcggcgcggcgacctccccgtctggctggcctacaaggtggccgcggaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgccgcgggccgcaagtccctgaccctgaacctcatcaccgagatgggccggctgcccacgttcatgacccagaaggcccgcaacgccctggacaacctcgccgtgctgcacaccgcggaggccgggggccgggcctacaaccacgccctgagcgagctccccgagaccctggagacgctgctcctgctgaccctcctggccaccgtcaccgggggcatcttcctgttcctcatgtccggcaaggggatcggcaagatgaccctggggatgtgctgcatcatcacggcgagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggcggccacgatggccaacgagatgggcttcctggagaagaccaagaaggacttcgggctgggcagcatcaccacccagcagccggagagcaacatcctcgacatcgacctgcggcccgcctccgcctggacgctgtacgcggtcgccaccaccttcatcacccccatgctccgccacagcatcgagaactccagcgtgaacgtgtccctgacggccatcgccaaccaggccaccgtcctgatgggcctcgggaagggctggcccctgagcaagatggacatcggggtgccgctgctcgcgatcggctgctactcccaggtgaaccccatcaccctgaccgccgccctgctcctgctggtcgcccactacgcgatcatcgggcccggcctccaggccaaggccacgcgggaggcccagaagcgcgccgcggccggcatcatgaagaaccccaccgtggacgggatcaccgtgatcgacctggacccgatcccctacgaccccaagttcgagaagcagctgggccaggtcatgctcctggtgctgtgcgtgacccaggtcctcatgatgcggacgacctgggccctgtgcgaggccctgaccctcgccaccgggcccatcagcacgctgtgggagggcaacccggggcgcttctggaacaccaccatcgcggtgtccatggccaacatcttccgcggcagctacctggccggcgccgggctcctgttctccatcatgaagaacaccgccaacacgcggcgcggcaccgggaacaccggcgagaccctgggcgagaagtggaagaaccggctcaacacgctgggcaagagcgagttccagatctacaagaagtccggcatccaggaggtggaccgcaccctggcgaaggaggggatcaagcggggcgagaccgaccaccacgccgtcagccgcgggtccgccaagctccggtggttcgtggagcgcaacctggtgacccccgagggcaaggtcgtggacctgggctgcgggcggggcgggtggagctactactgcggcgggctcaagaacgtgaaggaggtcaagggcctgacgaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgaccgtggaggccggccggacgctccgcgtgctgaacctggtcgagaactggctcaacaacaacacccagttctgcatcaaggtgctgaacccctacatgcccagcgtgatcgagaagatggaggcgctgcagcggaagtacggcggggccctggtccgcaacccgctctcccggaacagcacccacgagatgtactgggtgtccaacgccagcggcaacatcgtgtccagcgtcaacatgatctcccgcatgctgatcaaccggttcaccatgcgccacaagaaggccacgtacgagcccgacgtggacctggggagcggcacccggaacatcgggatcgagtccgagatccccaacctcgacatcatcggcaagcgcatcgagaagatcaagcaggagcacgagaccagctggcactacgaccaggaccacccctacaagacctgggcctaccacggctcctacgagacgaagcagaccgggagcgcgtccagcatggtgaacggcgtcgtgcgcctgctgaccaagccgtgggacgtgatccccatggtcacccagatggccatgacggacaccacccccttcgggcagcagcgggtgttcaaggagaaggtcgacacccgcacgcaggagcccaaggagggcaccaagaagctcatgaagatcaccgccgagtggctgtggaaggagctgggcaagaagaagacccggcgcatgtgcacgcgggaggagttcacccgcaaggtgcggtccaacgccgccctcggggcgatcttcaccgacgagaacaagtggaagtccgcccgcgaggccgtggaggactccggcttctgggagctggtcgacaaggagcggaacctgcacctcgaggggaagtgcgagacctgcgtgtacaacatgatgggcaagcgcgagaagaagctgggggagttcggcaaggccaagggcagccgggccatctggtacatgtggctgggggcgcgcttcctcgagttcgaggccctgggcttcctgaacgaggaccactggttctcccgggagaacagcctcagcggggtggagggcgaggggctgcacaagctgggctacatcctccgcgacgtctccaagaaggagggcggggccatgtacgccgacgacacggcgggctgggacacccggatcaccctggaggacctgaagaacgaggagatggtgaccaaccacatggagggggagcacaagaagctcgccgaggccatcttcaagctgacgtaccagaacaaggtggtccgcgtgcagcggccgacgccccggggcaccgtgatggacatcatcagccggcgcgaccagcgggggtccggccaggtcgtgacctacggcctgaacacgttcaccaacatggaggcccagctcatccgccagatggagggggagggcgtgttcaagagcatccagcagctgaccgtcaccgaggagatcgccgtgaagaactggctggagcgcgtggggcgggagcgcctctcccggatggcgatcagcggcgacgactgcgtcgtgaagcccctggacgaccgcttcgcctccgccctgacggccctcaacgacatgggcaaggtgcggaaggacatccagcagtgggagcccagccgcgggtggaacgactggacccaggtcccgttctgctcccaccacttccacgagctgatcatgaaggacggccgggtgctggtggtcccctgccgcaaccaggacgagctcatcgggcgggcccgcatcagccagggcgcggggtggtccctgcgggagaccgcctgcctgggcaagagctacgcccagatgtggtccctcatgtacttccaccgccgggacctgcgcctggccgccaacgcgatctgcagcgccgtgccctcccactgggtgcccaccagccggaccacgtggtccatccacgccacccacgagtggatgaccaccgaggacatgctcacggtctggaaccgcgtgtggatccaggagaacccgtggatggaggacaagacccccgtggagagctgggaggagatcccctacctgggcaagcgggaggaccagtggtgcgggagcctgatcggcctcacctcccgcgccacctgggccaagaacatccagacggcgatcaaccaggtccggagcctgatcgggaacgaggagtacaccgactacatgccctccatgaagcgcttccgccgggaggaggaggaggccggcgtgctgtggtga

SEQ ID NO: 9728 - RNA, 9873 nt, synthetic construct
  misc_feature 1..9873: note = derived and/or modified CDS sequence (opt1) from DENV-2__JX567951__SS-prME
  source 1..9873: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcatcggcaagcggatcgagaagatcaagcaggagcacgagacctcctggcactacgaccaggaccacccctacaagacctgggcctaccacgggagctacgagacgaagcagaccggctccgcgagctccatggtcaacggggtggtgcgcctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtgcggagcaacgccgccctgggcgcggtcttcaccgacgagaacaagtggaagtccgcccgcgaggccgtggaggacgggcggttctgggagctggtggaccgcgagcggaacctccacctggagggcaagtgcgagacctgcgtctacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtggagggcgagggcctgcaccgcctcgggtacatcctgcgggaggtcggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccggggcaccgtgatggacatcatctcccgcaaggaccagcgggggagcggccaggtcgggacctacggcctcaacacgttcaccaacatggaggcccagctgatccgccagatggagggcgaggggatcttcaagtccatccagcacctgaccgccaccgaggagatcgcggtgcagaactggctcgcccgcgtgggccgggagcgcctgagccggatggccatctccggggacgactgcgtcgtgaagcccatcgacgaccgcttcgccagcgccctgacggcgctcaacgacatgggcaaggtgcggaaggacatccagcagtgggagccctcccgcgggtggaacgactggacccaggtcccgttctgcagccaccacttccacgagctggtgatgaaggacggccgggtgctggtcgtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtgccctcccactgggtccccaccagccgcacgacctggtccatccacgcgaagcacgagtggatgaccaccgaggacatgctcgccgtgtggaaccgggtgtggatccaggagaacccgtggatggaggacaagacgcccgtcgagagctgggaggaggtgccctacctgggcaagcgcgaggaccagtggtgcgggtccctgatcggcctcaccagccgggccacctgggccaagaacatccagaccgccatcaaccaggtgcgcagcctgatcggcaacgaggggtacacggactacatgccctccatgaagcggttccgccgcgaggaggaggaggcgggcgtcctgtgg

SEQ ID NO: 9729 - RNA, 9873 nt, synthetic construct
  misc_feature 1..9873: note = derived and/or modified CDS sequence (opt1) from DENV-2__JX567950__SS-prME
  source 1..9873: mol_type = other RNA
accgccggggtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcgaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctcgagaagcggcacgtgctggggcgcctgatcaccgtgaacccgatcgtcaccgagaaggacagccccgtgaacatcgaggcggagccgcccttcggcgactcctacatcatcgtgggggtcgagccgggccagctcaagctgaactggttcaagaaggggagctccatcggccagatgttcgagacgaccatgcgcggcgccaagcggatggccatcctgggggacaccgcctgggacttcggcagcctcgggggcgtgttcacctccatcgggaaggccctgcaccaggtgttcggcgcgatctacggcgccgccttcagcggggtctcctggacgatgaagatcctgatcggcgtgatcatcacctggatcgggatgaacagccgctccaccagcctgtccgtgagcctcgtcctggtgggcgtggtcaccctgtacctcggggccatggtgcaggcggactccggctgcatcgtgagctggaagaacaaggagctgaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctcgagaacctgatgtggaagcagatcacgcccgagctgaaccacatcctctccgagaacgaggtgaagctgaccatcatgaccggcgacatcaaggggatcatgcaggccggcaagcggagcctgcgcccgcagcccaccgagctcaagtactcctggaagacgtggggcaaggcgaagatgctgagcaccgagtcccacaaccagaccttcctgatcgacgggcccgagaccgccgagtgcccgaacacgaaccgggcctggaacagcctcgaggtcgaggactacggcttcggggtgttcaccaccaacatctggctgaagctgcgcgagaagcaggacgtgttctgcgactccaagctcatgagcgccgccatcaaggacaaccgggcggtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgccgggcccgtctcccagcacaactaccgcccgggctaccacacgcagaccgcggggccctggcacctgggcaagctggagatggacttcgacttctgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcacgaagcacgcgatcctcctggtggccctgagcttcgtcaccctcatcaccgggaacatgtccttccgggacctgggccgcgtgatggtgatggtcggggccaccatgacggacgacatcggcatgggcgtgacctacctggccctcctggccgcgttcaaggtgcgccccaccttcgccgccgggctgctcctgcggaagctgaccagcaaggagctcatgatggccacgatcggcatcgccctgctgtcccagagcaccctccccgagaccatcctggagctgaccgacgcgctcgccctggggatgatggccctgaagatcgtccgcaacatggagaagtaccagctcgccgtgacgatcatggccatctcctgcgtgccgaacgcggtcatcctgcagaacgcctggaaggtgagctgcaccatcctggccgccgtgtccgtcagccccctcctgctgacctccagccagcagaaggcggactggatccccctcgccctgaccatcaagggcctgaaccccacggccatcttcctcaccaccctgtcccggaccagcaagaagcgctcctggccgctgaacgaggccatcatggccgtgggcatggtcagcatcctcgcgtccagcctgctgaagaacgacatccccatgacggggcccctcgtggccggcgggctgctgaccgtgtgctacgtcctcaccggccggagcgccgacctggagctggagcgcgccgccgacgtgaagtgggaggaccaggcggagatctccgggagctcccccatcctcagcgtgaccatctccgaggacggcagcatgtccatcaagaacgaggaggaggagcagacgctgaccatcctgatccggaccggcctcctggtcatcagcggggtgttcccggtgtccatccccatcaccgccgccgcctggtacctgtgggaggtcaagaagcagcgcgccggcgtgctctgggacgtgcccagcccgccgcccgtcgggaaggcggagctggaggacggcgcctaccggatcaagcagcgcgggatcctgggctactcccagatcggcgccggggtgtacaaggagggcaccttccacacgatgtggcacgtgacccgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgcgctggagcccgggaagaacccccgcgccgtgcagaccaagcccggcatcttcaagaccaacacggggaccatcggcgccgtgagcctggacttctcccccggcaccagcgggtcccccatcgtcgaccggaagggcaaggtggtggggctctacggcaacggcgtcgtgacccgcagcggggcctacgtgtccgcgatcgcccagacggagaagtccatcgaggacaaccccgagatcgaggacgacatcttccggaagaagcgcctgaccatcatggacctgcaccccggcgccgggaagaccaagcggtacctgcccgccatcgtccgcgaggccatcaagcggggcctccgcaccctgatcctggcgccgacgcgcgtggtggccgccgagatggaggaggccctccgggggctgcccatccgctaccagacccccgccatccgggcggagcacaccggccgcgagatcgtcgacctgatgtgccacgccaccttcacgatgcggctcctgagccccgtgcgcgtgccgaactacaacctgatcatcatggacgaggcccacttctccgaccccgccagcatcgccgcgcggggctacatctccacccgcgtcgagatgggggaggccgccggcatcttcatgaccgccacgccgcccgggagccgggacccgttcccccagtccaacgcgcccatcatggacgaggagcgcgagatccccgagcggagctggaactccggccacgagtgggtgacggacttcaaggggaagaccgtgtggttcgtcccgagcatcaaggccggcaacgacatcgccgcctgcctccgcaagaacggcaagaaggtgatccagctgtcccggaagaccttcgacagcgagtacgtgaagacccgcgccaacgactgggacttcgtcgtgacgaccgacatctccgagatgggggcgaacttcaaggccgagcgggtgatcgacccccgccggtgcatgaagcccgtcatcctgaccgacggcgaggagcgcgtgatcctcgccgggcccatgccggtgacccacagctccgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacgcccgagggcatcatcccgagcatgttcgagcccgagcgcgagaaggtcgacgccatcgacggggagtaccggctgcgcggcgaggcccggaagaccttcgtggacctgatgcgccgcggggacctccccgtgtggctggcctacaaggtcgcggccgagggcatcaactacgccgaccgcaagtggtgcttcgacgggatcaagaacaaccagatcctggaggagaacgtggaggtggagatctggaccaaggagggcgagcggaagaagctcaagccgcgctggctggacgcccggatctactccgaccccctggcgctcaaggagttcaaggagttcgccgccggccgcaagagcctgaccctgaacctcatcacggagatggggcggctgcccaccttcatgacccagaaggcccgcaacgccctggacaacctcgcggtcctgcacaccgccgaggtgggcgggaaggcctacacgcacgccctgaacgagctccccgagaccctggagaccctgctcctgctgaccctcctggccgcggtcacgggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgcgatcctcacggtggtggccgccaccatggccaacgagatggggttcctggagaagaccaagaagtacctgggcctcggcagcatcaccacgcaggagagcgagtccaacatcctggacatcgacctgcgcccggccagcgcgtggaccctctacgccgtcgccaccaccttcgtgacgcccatgctgcggcactccatcgtgaacagctccgtcaacgtgaccctgaccgccatcgcgaaccaggccaccgtgctcatggggctgggcaaggggtggcccctgagcaagatggacatcggcgtccccctcctggccatcgggtgctactcccaggtgaacccgatcacgctgaccgccgccctcctgctgctcgtggcgcactacgccatcatcggccccggcctgcaggccaaggccacccgcgaggcccagaagcgggcggccgccgggatcatgaagaaccccaccgtcgacggcatcacggtgatcgacctggagcccatcccgtacgaccccaagttcgagaagcagctcgggcaggtcatgctgctgatcctctgcgtcacccaggtgctgatgatgcgcaccacctgggccctgtgcgaggccctcacgctggcgaccggccccatcagcaccctgtgggaggggaaccccggccggttctggaacaccacgatcgccgtgtccatggccaacatcttccgcggcagctacctcgccggggcgggcctgctgttctccatcatgaagaacaccaccaacacccgccgggggacgggcaacgtcggcgagaccctcggggagaagtggaagtcccgcctgaacgccctgggcaagaacgagttccagatctacaagaagtccgggatccaggaggtggaccggaccctcgccaaggagggcatcaagcgcggggagaccgaccaccacgccgtgagccggggctccgccaagctgcgctggttcgtcgagcggaacatggtgacgccggagggcaaggtggtcgacctggggtgcggccgcgggggctggagctactactgcgggggcctcaagaacgtgcgggaggtgaagggcctgaccaagggcgggcccgggcacgaggagcccatccccatgtccacctacggctggaacctggtccgcctccagagcggggtggacgtgttcttcaccccgcccgagaagtgcgacacgctgctgtgcgacatcggcgagtccagccccaaccccaccatcgaggcgggccggaccctccgcgtcctgaacctggccgagaactggctcaacaacaacacccagttctgcatcaaggtgctgaacccgtacatgcccagcgtgatcgagaagatggagaccctgcagcggaagtacgggggcgccctggtccgcaaccccctctcccggaacagcacgcacgagatgtactgggtgtccaacgccaccgggaacatcgtgagctccgtcaacatgatcagccgcatgctgatcaaccggttcaccatgaagcacaagaaggccacctacgagccggacgtggacctgggctccgggacgcgcaacatcggcatcgagagcgagatccccaacctcgacatcatcggcaagcggatcgagaagatcaagcaggagcacgagacctcctggcactacgaccaggaccacccctacaagacctgggcgtaccacgggagctacgagaccaagcagacgggctccgccagctccatggtgaacggggtcgtgcgcctgctgaccaagccctgggacgtggtcccgatggtgacccagatggccatgaccgacacgacccccttcggccagcagcgcgtgttcaaggagaaggtcgacacccggacccaggagcccaaggagggcacgaagaagctcatgaagatcaccgccgagtggctgtggaaggagctggggaaggagaagacgccccggatgtgcacccgggaggagttcacgcgcaaggtgcggagcaacgccgcgctcggcgccgtgttcaccgacgagaacaagtggaagtccgcccgcgaggccgtcgaggacgggcggttctgggagctggtggaccgcgagcggaacctgcacctcgagggcaagtgcgagacctgcgtctacaacatgatggggaagcgcgagaagaagctgggcgagttcggcaaggcgaaggggagccgggccatctggtacatgtggctgggcgcccgcttcctcgagttcgaggccctggggttcctgaacgaggaccactggttctcccgggagaacagcctctccggcgtggagggggagggcctgcaccgcctgggctacatcctccgggacgtgagcaagaaggagggcggggccatgtacgcggacgacaccgccgggtgggacacgcgcatcaccctggaggacctgaagaacgaggagatggtcaccaaccacatgaagggcgagcacaagaagctcgccgaggccatcttcaagctgacctaccagaacaaggtggtgcgggtccagcgcccgacgccccgggggaccgtgatggacatcatcagccgccgggaccagcgcggctccggccaggtggggacctacggcctgaacaccttcacgaacatggaggcccagctcatccgccagatggagggggagggcatcttcaagagcatccagcacctgaccgcgaccgaggagatcgccgtccagaactggctggcccgggtgggccgcgagcggctctcccgcatggccatcagcggggacgactgcgtggtcaagcccatcgacgaccggttcgcctccgcgctgaccgccctgaacgacatgggcaaggtgcgcaaggacatccagcagtgggagcccagccgggggtggaacgactggacccaggtgccgttctgctcccaccacttccacgagctcgtcatgaaggacggccgcgtgctggtggtcccctgccggaaccaggacgagctgatcgggcgcgcccggatcagccagggcgccggctggtccctcaaggagaccgcctgcctgggcaagagctacgcgcagatgtggaccctgatgtacttccaccgccgggacctccgcctggccgccaacgccatctgctccgcggtgcccagccactgggtgcccacctcccggaccacgtggagcatccacgccaagcacgagtggatgaccaccgaggacatgctggccgtctggaaccgcgtgtggatccaggagaacccgtggatggaggacaagacccccgtggagtcctgggaggagatcccctacctcggcaagcgggaggaccagtggtgcgggagcctgatcggcctgacgtcccgcgccacctgggccaagaacatccagaccgcgatcaaccaggtccggagcctcatcgggaacgagggctacaccgactacatgcccagcatgaagcgcttccgccgggaggaggaggaggccggcgtgctgtgg

SEQ ID NO: 9730 - RNA, 9873 nt, synthetic construct
  misc_feature 1..9873: note = derived and/or modified CDS sequence (opt1) from DENV-2__HQ012538__SS-prME
  source 1..9873: mol_type = other RNA
accgcgggcgtgatcatcatgctgatccccaccgcgatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggtgaccatgaccgacgacatcggcatgggcgtgacctacctggccctgctcgccgcgttcaaggtccgccccacgttcgccgccgggctgctgctccggaagctgaccagcaaggagctgatgatggccaccatcggcatcgccctcctgtcccagagcaccatccccgagacgatcctggagctcaccgacgcgctggccctggggatgatggtgctcaagatcgtgcgcaacatggagaagtaccagctggccgtcaccatcatggccatctcctgcgtgccgaacgccgtgatcctgctcaacgcgtggaaggtcagctgcaccatcctggccgccgtgtccgtcagccccctgctcctgacgtccagccagcagaagaccgactggatccccctggccctcaccatcaagggcctgaaccccaccgcgatcttcctgacgaccctctcccggaccagcaagaagcgctcctggccgctgaacgaggccgtgatggccgtgggcatggtcagcatcctggcctccagcctcctgaagaacgacatccccatgaccgggcccctggtggccggcgggctcctgacggtgtgctacgtcctgaccggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtgatcagcggggtcttcccggtgtccatccccatcaccgccgcggcctggtacctgtgggaggtgaagaagcagcgcgccggcgtcctgtgggacgtgcccagcccgccgcccgtggagaaggccgagctcgaggacggggcctaccggatcaagcagcgcggcatcctggggtactcccagatcggcgcgggcgtctacaaggaggggaccttccacaccatgtggcacgtgacgcggggcgccgtgctgatgcaccgcgggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacaccggcacgatcggggcggtgagcctggacttctcccccggcaccagcggctcccccatcgtggaccggaaggggaaggtcgtgggcctctacgggaacggcgtggtcacccgcagcggcgcctacgtgtccgccatcgcccagaccgagaagtccatcgaggacaaccccgagatcgaggacgacatcttccggaagaagcgcctgacgatcatggacctgcaccccggggcgggcaagaccaagcggtacctgcccgccatcgtgcgcgaggccatcaagcgggggctccgcaccctgatcctggccccgacccgcgtcgtggccgcggagatggaggaggccctccggggcctgcccatccgctaccagacgcccgccatccgggccgagcacaccgggcgcgagatcgtggacctgatgtgccacgccaccttcaccatgcggctcctgagccccgtccgcgtgccgaactacaacctgatcatcatggacgaggcgcacttcacggaccccgcctccatcgccgcccggggctacatcagcacccgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtcacggacttcaagggcaagaccgtgtggttcgtgccgtccatcaaggccgggaacgacatcgcggcctgcctccgcaagaacggcaagaaggtcatccagctgagccggaagaccttcgactccgagtacgtgaagacccgcgccaacgactgggacttcgtggtcacgaccgacatcagcgagatgggcgccaacttccgggccgagcgcgtgatcgacccccggcgctgcatgaagcccgtgatcctgaccgacggggaggagcgggtcatcctcgcgggccccatgccggtgacccactccagcgccgcccagcgccgcgggcggatcggccgcaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgggagaaggtggacgcgatcgacggcgagtaccgcctgcgcggggaggcccgcaagaccttcgtcgacctgatgcggcgcggcgacctccccgtgtggctggcctaccgggtggccgccgaggggatcaactacgcggaccgccggtggtgcttcgacggcatcaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcacggagatgggccgcctgcccaccttcatgacccagaaggcccgggacgccctggacaacctcgccgtcctgcacaccgccgaggccggcgggcgcgcctacaaccacgccctgagcgagctccccgagacgctggagaccctgctcctgctgaccctcctggccaccgtgaccggcgggatcttcctgttcctcatgtccgggaaggggatcggcaagatgaccctggggatgtgctgcatcatcaccgccagcatcctgctctggtacgcgcagatccagccgcactggatcgccgcctccatcatcctggagttcttcctgatcgtgctcctgatccccgagcccgagaagcagcggacgccccaggacaaccagctgacctacgtcgtgatcgccatcctcacggtggtcgccgcgaccatggccaacgagatgggcttcctggagaagaccaagaaggacctggggctcggcagcatcaccacgcaggagagcgagtccaacatcctggacatcgacctgcgcccggccagcgcctggaccctctacgccgtggcgaccaccttcgtgacgcccatgctgcggcactccatcgagaacagctccgtcaacgtgagcctgaccgccatcgccaaccaggccaccgtgctcatgggcctggggaagggctggcccctgtccaagatggacatcggggtccccctcctggcgatcggctgctacagccaggtgaacccgatcaccctgacggccgccctcctgctgctcgtggcccactacgccatcatcgggcccggcctgcaggcgaaggccacccgcgaggcccagaagcgcgccgccgcgggcatcatgaagaaccccaccgtcgacgggatcaccgtgatcgacctggagcccatcccgtacgaccccaagttcgagaagcagctcggccaggtgatgctgctgatcctctgcgtcacccaggtgctgatgatgcggaccacctgggccctgtgcgaggccctcaccctggccacggggcccatctccaccctgtgggagggcaaccccgggcgcttctggaacaccaccatcgccgtgagcatggcgaacatcttccggggctcctacctcgccggcgccgggctgctgttcagcatcatgaagaacacgaccaacacccgccggggcaccgggaacatcggcgagacgctcggcgagaagtggaagtcccgcctgaacgccctgggcaagagcgagttccagatctacaagaagtccggcatccaggaggtcgaccggaccctcgcgaaggaggggatcaagcgcggcgagaccgaccaccacgccgtgagccgggggtccgccaagctgcgctggttcgtggagcggaacatggtcaccccggagggcaaggtggtggacctgggctgcgggcgcggcgggtggagctactactgcggcgggctcaagaacgtccgggaggtgaagggcctgacgaagggcgggcccggccacgaggagcccatccccatgtccacctacgggtggaacctggtgcgcctccagagcggcgtcgacgtgttcttcaccccgcccgagaagtgcgacaccctgctgtgcgacatcggggagagctcccccaaccccacgatcgaggccggccggaccctccgcgtgctgaacctggtcgagaactggctcaacaacaacacccagttctgcatcaaggtgctgaacccgtacatgcccagcgtgatcgagaagatggagaccctgcagcggaagtacggcggggccctggtccgcaaccccctctcccggaacagcacccacgagatgtactgggtgtccaacgcgacgggcaacatcgtgagctccgtcaacatgatcagccgcatgctgatcaaccgcttcaccatgaagcacaagaaggccacctacgagccggacgtggacctggggtccggcacccggaacatcgggatcgagagcgagatccccaacctcgacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtcgtgcggctgctgacgaagccctgggacgtggtcccgatggtgacccagatggccatgaccgacaccacgcccttcgggcagcagcgcgtgttcaaggagaaggtcgacacccggacccaggagcccaaggagggcaccaagaagctcatgcgcatcacggcggagtggctgtggaaggagctgggcaagaagaagacgccccggatgtgcacccgcgaggagttcacccggaaggtgcgcagcaacgccgccctcggggccatcttcacggacgagaacaagtggaagtccgcccgggaggcggtggaggacagccgcttctgggagctggtcgaccgggagcgcaacctgcacctcgagggcaagtgcgagacctgcgtgtacaacatgatggggaagcgggagaagaagctgggcgagttcgggaaggccaagggctcccgcgccatctggtacatgtggctgggcgcccggttcctcgagttcgaggcgctggggttcctgaacgaggaccactggttcagccgcggcaacagcctctccggggtcgagggcgaggggctgcaccggctgggctacatcctccgcgacgtgagcaagaaggagggcggggccatgtacgccgacgacaccgccggctgggacacccggatcacgctggaggacctgaagaacgaggagatggtgaccaaccacatgaagggggagcacaagaagctcgccgaggcgatcttcaagctgacctaccagaacaaggtcgtgcgcgtgcagcgcccgacgccccggggcacggtcatggacatcatctcccgccgggaccagcgcgggagcggccaggtgggcacctacgggctgaacaccttcaccaacatggaggcccagctcatccggcagatggagggcgaggggatcttcaagtccatccagcacctgacggtgaccgaggagatcgccgtccagaactggctggcccgcgtgggccgggagcgcctcagccggatggccatctccggcgacgactgcgtggtcaagcccctggacgaccgcttcgcgagcgccctgaccgccctcaacgacatggggaaggtgcggaaggacatccagcagtgggagccctcccgcggctggaacgactggacccaggtgccgttctgcagccaccacttccacgagctggtcatgaaggacgggcgggtgctggtggtcccctgccgcaaccaggacgagctcatcggccgggcccgcatctcccagggggccggctggagcctgaaggagacggcgtgcctgggcaagtcctacgcccagatgtggaccctcatgtacttccaccggcgcgacctgcggctggccgccaacgccatctgcagcgcggtgccctcccactgggtgcccaccagccgcaccacctggtccatccacgccaagcacgagtggatgacgaccgaggacatgctcgccgtctggaaccgcgtgtggatccaggagaacccgtggatggaggacaagacccccgtggagagctgggaggaggtcccctacctggggaagcgggaggaccagtggtgcggcagcctgatcgggctcacctcccgcgccacgtgggcgaagaacatccagaccgccatcaaccaggtgcggagcctgatcggcaacgaggagtacaccgactacatgccctccatgaagcgcttccggcgcgaggaggaggaggccggggtgctgtgg

SEQ ID NO: 9731 - RNA, 9873 nt, synthetic construct
  misc_feature 1..9873: note = derived and/or modified CDS sequence (opt1) from DENV-2__HQ012533__SS-prME
  source 1..9873: mol_type = other RNA
accgccggggtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggtgaccatgaccgacgacatcggcatgggcgtgacctacctggccctgctcgccgcgttcaaggtccgccccacgttcgccgccgggctgctgctccggaagctgaccagcaaggagctgatgatggccaccatcggcatcgccctcctgtcccagagcaccatccccgagacgatcctggagctcaccgacgcgctggccctggggatgatggtgctcaagatcgtgcgcaacatggagaagtaccagctggccgtcaccatcatggccatctcctgcgtgccgaacgccgtgatcctgctcaacgcgtggaaggtcagctgcaccatcctggccgccgtgtccgtcagccccctgctcctgacgtccagccagcagaagaccgactggatccccctggccctcaccatcaagggcctgaaccccaccgcgatcttcctgacgaccctctcccggaccagcaagaagcgctcctggccgctgaacgaggccgtgatggccgtgggcatggtcagcatcctggcctccagcctcctgaagaacgacatccccatgaccgggcccctggtggccggcgggctcctgacggtgtgctacgtcctgaccggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtgatcagcggggtcttcccggtgtccatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcctgggctactcccagatcggcgcgggggtctacaaggagggcaccttccacaccatgtggcacgtgacgcgcggggcggtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgccgtccagaccaagcccggcctgttcaagaccaacaccgggacgatcggcgcggtgagcctggacttctcccccggcaccagcgggtcccccatcgtggaccggaagggcaaggtcgtggggctctacggcaacggcgtggtcacccgcagcggggcctacgtgtccgccatcgcccagaccgagaagtccatcgaggacaaccccgagatcgaggacgacatcttccggaagaagcgcctgacgatcatggacctgcaccccggcgcggggaagaccaagcggtacctgcccgccatcgtgcgcgaggccatcaagcggggcctccgcaccctgatcctggccccgacccgcgtcgtggccgcggagatggaggaggccctccgggggctgcccatccgctaccagacgcccgccatccgggccgagcacaccggccgcgagatcgtggacctgatgtgccacgccaccttcaccatgcggctcctgagccccgtccgcgtgccgaactacaacctgatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtcacggacttcaaggggaagaccgtgtggttcgtgccgtccatcaaggccggcaacgacatcgcggcctgcctccgcaagaacggcaagaaggtcatccagctgagccggaagaccttcgactccgagtacgtgaagacccgcgccaacgactgggacttcgtggtcacgaccgacatcagcgagatgggggccaacttccgggccgagcgcgtgatcgacccccggcgctgcatgaagcccgtgatcctgaccgacggcgaggagcgggtcatcctcgcggggcccatgccggtgacccactccagcgccgcccagcgccgcggccggatcgggcgcaaccccaagaacgagaacgaccagtacatctacatgggcgagcccctggagaacgacgaggactgcgcccactggaaggaggccaagatgctgctcgacaacatcaacacgcccgagggcatcatcccgtccatgttcgagcccgagcgggagaaggtggacgcgatcgacggggagtaccgcctgcggggcgaggcccgcaagaccttcgtcgacctgatgcggcgcggggacctccccgtgtggctggcctaccgggtggccgccgagggcatcaactacgcggaccgccggtggtgcttcgacgggatcaagaacaaccagatcctggaggagaacgtcgaggtggagatctggaccaaggagggcgagcgcaagaagctcaagccgcggtggctggacgcccgcatctacagcgaccccctggccctcaaggagttcaaggagttcgccgcgggccggaagtccctgaccctgaacctcatcacggagatggggcgcctgcccaccttcatgacccagaaggcccgggacgccctggacaacctcgccgtcctgcacaccgccgaggcgggcgggcgcgcctacaaccacgccctgagcgagctccccgagacgctggagaccctgctcctgctgaccctcctggccaccgtgacgggcggcatcttcctgttcctcatgtccgggaagggcatcgggaagatgaccctgggcatgtgctgcatcatcaccgccagcatcctgctctggtacgcgcagatccagccgcactggatcgccgcctccatcatcctggagttcttcctgatcgtgctcctgatccccgagcccgagaagcagcggacgccccaggacaaccagctgacctacgtcgtgatcgccatcctcacggtggtcgccgcgaccatggccaacgagatggggttcctggagaagaccaagaaggacctgggcctcggcagcatcaccacgcaggagagcgagtccaacatcctggacatcgacctgcgcccggccagcgcctggaccctctacgccgtggcgaccaccttcgtgacgcccatgctgcggcactccatcgagaacagctccgtcaacgtgagcctgaccgccatcgccaaccaggccaccgtgctcatggggctgggcaaggggtggcccctgtccaagatggacatcggcgtccccctcctggcgatcgggtgctacagccaggtgaacccgatcaccctgacggccgccctcctgctgctcgtggcccactacgccatcatcggccccggcctgcaggcgaaggccacccgcgaggcccagaagcgcgccgccgcggggatcatgaagaaccccaccgtcgacggcatcaccgtgatcgacctggagcccatcccgtacgaccccaagttcgagaagcagctcggccaggtgatgctgctgatcctctgcgtcacccaggtgctgatgatgcggaccacctgggccctgtgcgaggccctcaccctggccacgggccccatctccaccctgtgggaggggaaccccggccgcttctggaacaccaccatcgccgtgagcatggcgaacatcttccggggctcctacctcgccggggccggcctgctgttcagcatcatgaagaacacgaccaacacccgccgggggaccggcaacatcggcgagacgctcggggagaagtggaagtcccgcctgaacgccctgggcaagagcgagttccagatctacaagaagtccgggatccaggaggtcgaccggaccctcgcgaaggagggcatcaagcgcggggagaccgaccaccacgccgtgagccggggctccgccaagctgcgctggttcgtggagcggaacatggtcaccccggagggcaaggtggtggacctggggtgcggccgcgggggctggagctactactgcgggggcctcaagaacgtccgggaggtgaagggcctgacgaagggcgggcccgggcacgaggagcccatccccatgtccacctacggctggaacctggtgcgcctccagagcggggtcgacgtgttcttcaccccgcccgagaagtgcgacaccctgctgtgcgacatcggcgagagctcccccaaccccacgatcgaggccggccggaccctccgcgtgctgaacctggtcgagaactggctcaacaacaacacccagttctgcatcaaggtgctgaacccgtacatgcccagcgtgatcgagaagatggagaccctgcagcggaagtacgggggcgccctggtccgcaaccccctctcccggaacagcacccacgagatgtactgggtgtccaacgcgacggggaacatcgtgagctccgtcaacatgatcagccgcatgctgatcaaccgcttcaccatgaagcacaagaaggccacctacgagccggacgtggacctgggctccgggacccggaacatcggcatcgagagcgagatccccaacctcgacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtcgtgcggctgctgacgaagccctgggacgtggtcccgatggtgacccagatggccatgaccgacaccacgcccttcggccagcagcgcgtgttcaaggagaaggtcgacacccggacccaggagcccaaggagggcaccaagaagctcatgcgcatcacggcggagtggctgtggaaggagctggggaagaagaagacgccccggatgtgcacccgcgaggagttcacccggaaggtgcgcagcaacgccgccctcggcgccatcttcacggacgagaacaagtggaagtccgcccgggaggcggtggaggacagccgcttctgggagctggtcgaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcccggttcctcgagttcgaggcgctgggcttcctgaacgaggaccactggttcagccgcgggaacagcctctccggcgtcgagggggagggcctgcaccggctgggctacatcctccgcgacgtgagcaagaaggagggcggggccatgtacgccgacgacaccgccgggtgggacacccggatcacgctggaggacctgaagaacgaggagatggtgaccaaccacatgaagggcgagcacaagaagctcgccgaggcgatcttcaagctgacctaccagaacaaggtcgtgcgcgtgcagcgcccgacgccccgggggacggtcatggacatcatctcccgccgggaccagcgcggcagcggccaggtggggacctacggcctgaacaccttcaccaacatggaggcccagctcatccggcagatggagggggagggcatcttcaagtccatccagcacctgacggtgaccgaggagatcgccgtccagaactggctggcccgcgtgggccgggagcgcctcagccggatggccatctccggggacgactgcgtggtcaagcccctggacgaccgcttcgcgagcgccctgaccgccctcaacgacatgggcaaggtgcggaaggacatccagcagtgggagccctcccgcgggtggaacgactggacccaggtgccgttctgcagccaccacttccacgagctggtcatgaaggacggccgggtgctggtggtcccctgccgcaaccaggacgagctcatcgggcgggcccgcatctcccagggcgccggctggagcctgaaggagacggcgtgcctggggaagtcctacgcccagatgtggaccctcatgtacttccaccggcgcgacctgcggctggccgccaacgccatctgcagcgcggtgccctcccactgggtgcccaccagccgcaccacctggtccatccacgccaagcacgagtggatgacgaccgaggacatgctcgccgtctggaaccgcgtgtggatccaggagaacccgtggatggaggacaagacccccgtggagagctgggaggaggtcccctacctgggcaagcgggaggaccagtggtgcgggagcctgatcggcctcacctcccgcgccacgtgggcgaagaacatccagaccgccatcaaccaggtgcggagcctgatcgggaacgaggagtacaccgactacatgccctccatgaagcgcttccggcgcgaggaggaggaggccggcgtgctgtgg

SEQ ID NO: 9732 - RNA, 9873 nt, synthetic construct
  misc_feature 1..9873: note = derived and/or modified CDS sequence (opt1) from DENV-2__HQ012534__SS-prME
  source 1..9873: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccaccccggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctgttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatgctgggggtccccatgaccgacgacatcggcatgggcgtgacctacctggccctcctggccgcgttcaaggtgcgccccaccttcgccgccgggctgctcctgcggaagctgacgagcaaggagctcatgatggccaccatcggcatcgccctgctgtcccagagcaccatcccggagaccatcctcgagctgacggacgcgctggccctcgggatgatggtcctgaagatcgtgcgcaacatggagaagtaccagctggccgtgaccatcatggccatctcctgcgtccccaacgccgtgatcctcctgaacgcgtggaaggtgagctgcaccatcctggccgccgtctccgtgagccccctcctgctgacctccagccagcagaagacggactggatccccctcgccctgaccatcaagggcctgaacccgaccgcgatcttcctcaccacgctgtcccggaccagcaagaagcgctcctggcccctgaacgaggccgtcatggccgtgggcatggtgagcatcctcgcctccagcctgctgaagaacgacatccccatgaccgggcccctcgtcgccggcgggctgctgaccgtgtgctacgtgctcacgggccggagcgcggacctggagctggagcgcgccgccgacgtcaagtgggaggaccaggccgagatctccgggagctccccgatcctcagcatcaccatctccgaggacggcagcatgtccatcaagaacgaggaggaggagcagaccctgaccatcctgatccggacgggcctcctggtgatcagcggggtgttccccgtctccatccccatcaccgccgcggcctggtacctgtgggaggtgaagaagcagcgcgccggcgtgctctgggacgtccccagcccgccgcccgtggggaaggccgagctggaggacggcgcctaccggatcaagcagcgcgggatcctgggctactcccagatcggcgcgggggtgtacaaggagggcaccttccacaccatgtggcacgtcacccgcggggcggtgctcatgcaccgcggcaagcggatcgagccgagctgggccgacgtgaagaaggacctgatctcctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtcagcctcgacttctccccgggcacgagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgaccatcatggacctgcaccccggcgcggggaagacgaagcggtacctcccggccatcgtgcgcgaggccatcaagcggggcctgcgcaccctgatcctcgcccccacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgagcccggtgcgcgtccccaactacaacctcatcatcatggacgaggcgcacttcaccgaccccgcctccatcgccgcccggggctacatcagcacgcgcgtggagatgggggaggccgcgggcatcttcatgaccgccacgccgcccgggtcccgggaccccttcccccagagcaacgcccccatcatggacgaggagcgcgagatccccgagcggtcctggaacagcggccacgagtgggtgaccgacttcaaggggaagacggtctggttcgtgccctccatcaaggccggcaacgacatcgcggcctgcctgcgcaagaacggcaagaaggtgatccagctgagccggaagaccttcgactccgagtacgtcaagacccgcgccaacgactgggacttcgtggtgaccacggacatcagcgagatgggggccaacttccgggccgagcgcgtcatcgacccccggcgctgcatgaagcccgtgatcctcaccgacggcgaggagcgggtgatcctggcggggccgatgcccgtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacaccccggagggcatcatcccctccatgttcgagcccgagcgggagaaggtggacgcgatcgacggggagtaccgcctgcggggcgaggcccgcaagacgttcgtggacctcatgcggcgcggggacctgccggtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccccggtggctggacgcccgcatctacagcgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggcgggcgggcgcgcctacaaccacgccctcagcgagctgccggagaccctggagacgctcctgctgctcaccctgctggccaccgtcaccggcggcatcttcctcttcctgatgtccgggaagggcatcgggaagatgacgctgggcatgtgctgcatcatcaccgccagcatcctcctgtggtacgcgcagatccagccccactggatcgccgcctccatcatcctggagttcttcctcatcgtgctgctgatccccgagcccgagaagcagcggaccccgcaggacaaccagctcacctacgtggtcatcgccatcctgaccgtggtggccgcgacgatggccaacgagatggggttcctggagaagaccaagaaggacctcggcctgggcagcatcaccacccaggagagcgagtccaacatcctggacatcgacctccgccccgccagcgcctggacgctgtacgccgtcgcgaccaccttcgtgacccccatgctgcggcactccatcgagaacagctccgtgaacgtcagcctcacggccatcgccaaccaggccaccgtgctgatggggctgggcaaggggtggcccctctccaagatggacatcggcgtgccgctgctggcgatcgggtgctacagccaggtcaaccccatcaccctcaccgccgccctgctgctcctggtggcccactacgccatcatcggccccggcctgcaggcgaaggccacgcgcgaggcccagaagcgcgccgccgcggggatcatgaagaaccccaccgtggacggcatcaccgtcatcgacctcgagccgatcccctacgaccccaagttcgagaagcagctgggccaggtgatgctgctcatcctgtgcgtgacccaggtcctgatgatgcggacgacctgggccctctgcgaggccctgaccctggccaccggccccatctccacgctctgggaggggaacccgggccgcttctggaacaccaccatcgccgtgagcatggcgaacatcttccggggctcctacctggccggggccggcctcctcttcagcatcatgaagaacaccacgaacacccgccgggggaccggcaacatcggcgagaccctgggggagaagtggaagtcccgcctgaacgccctcggcaagagcgagttccagatctacaagaagtccgggatccaggaggtggaccggacgctggcgaaggagggcatcaagcgcggggagaccgaccaccacgccgtcagccggggctccgccaagctgcgctggttcgtggagcggaacatggtgacccccgagggcaaggtcgtggacctcgggtgcggccgcgggggctggagctactactgcgggggcctgaagaacgtgcgggaggtcaagggcctgaccaagggcgggcccgggcacgaggagcccatcccgatgtccacgtacggctggaacctcgtgcgcctgcagagcggggtggacgtcttcttcacgccgcccgagaagtgcgacaccctgctctgcgacatcggcgagagctcccccaacccgaccatcgaggccggccggacgctgcgcgtgctgaacctcgtggagaactggctgaacaacaacacccagttctgcatcaaggtcctgaacccctacatgcccagcgtgatcgagaagatggagaccctgcagcggaagtacgggggcgccctcgtgcgcaacccgctgtcccggaacagcacccacgagatgtactgggtctccaacgcgaccgggaacatcgtgagctccgtgaacatgatcagccgcatgctgatcaaccgcttcacgatgaagcacaagaaggccacctacgagcccgacgtcgacctcggctccgggacccggaacatcggcatcgagagcgagatccccaacctggacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtggtccggctgctcaccaagccgtgggacgtggtgcccatggtcacgcagatggccatgaccgacaccacccccttcggccagcagcgcgtgttcaaggagaaggtggacacgcggacccaggagcccaaggagggcaccaagaagctgatgcgcatcaccgcggagtggctgtggaaggagctcgggaagaagaagacgccgcggatgtgcacccgcgaggagttcacccggaaggtccgcagcaacgccgccctgggcgccatcttcaccgacgagaacaagtggaagtccgcccgggaggcggtggaggacagccgcttctgggagctggtggaccgggagcgcaacctccacctggaggggaagtgcgagacgtgcgtctacaacatgatgggcaagcgggagaagaagctgggggagttcggcaaggccaagggctcccgcgccatctggtacatgtggctcggggcccggttcctggagttcgaggcgctgggcttcctcaacgaggaccactggttcagccgcgggaacagcctgtccggcgtggagggggagggcctgcaccggctcggctacatcctgcgcgacgtcagcaagaaggagggcggggccatgtacgccgacgacaccgccgggtgggacacccggatcaccctggaggacctcaagaacgaggagatggtgacgaaccacatgaagggcgagcacaagaagctggccgaggcgatcttcaagctgacctaccagaacaaggtggtccgcgtgcagcgccccacgccccgggggaccgtgatggacatcatctcccgccgggaccagcgcggcagcggccaggtcgggacgtacggcctcaacaccttcaccaacatggaggcccagctgatccggcagatggagggggagggcatcttcaagtccatccagcacctgaccgtgacggaggagatcgccgtgcagaactggctcgcccgcgtcggccgggagcgcctgagccggatggccatctccggggacgactgcgtggtgaagcccctggacgaccgcttcgcgagcgccctcaccgccctgaacgacatgggcaaggtccggaaggacatccagcagtgggagccgtcccgcgggtggaacgactggacccaggtgcccttctgcagccaccacttccacgagctggtgatgaaggacggccgggtcctcgtggtgccctgccgcaaccaggacgagctgatcgggcgggcccgcatctcccagggcgccggctggagcctgaaggagaccgcgtgcctcgggaagtcctacgcccagatgtggacgctgatgtacttccaccggcgcgacctgcggctcgccgccaacgccatctgcagcgcggtcccctcccactgggtgccgaccagccgcaccacctggtccatccacgccaagcacgagtggatgaccacggaggacatgctggccgtgtggaaccgcgtctggatccaggagaacccctggatggaggacaagacccccgtggagagctgggaggaggtgccctacctgggcaagcgggaggaccagtggtgcgggagcctcatcggcctgacctcccgcgccacctgggcgaagaacatccagacggccatcaaccaggtccggagcctgatcgggaacgaggagtacaccgactacatgccgtccatgaagcgcttccggcgcgaggaggaggaggccggcgtgctctgg

SEQ ID NO: 9733 - RNA, 9873 nt, synthetic construct
  misc_feature 1..9873: note = derived and/or modified CDS sequence (opt1) from DENV-2__HQ012535__SS-prME
  source 1..9873: mol_type = other RNA
accgcgggcgtgatcatcatgctgatccccaccgcgatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcgaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggtgaccatgaccgacgacatcggcatgggcgtgacctacctggccctgctcgccgcgttcaaggtccgccccacgttcgccgccgggctgctgctccggaagctgaccagcaaggagctgatgatggccaccatcggcatcgccctcctgtcccagagcaccatccccgagacgatcctggagctcaccgacgcgctggccctggggatgatggtgctcaagatcgtgcgcaacatggagaagtaccagctggccgtcaccatcatggccatctcctgcgtgccgaacgccgtgatcctgctcaacgcgtggaaggtcagctgcaccatcctggccgccgtgtccgtcagccccctgctcctgacgtccagccagcagaagaccgactggatccccctggccctcaccatcaagggcctgaaccccaccgcgatcttcctgacgaccctctcccggaccagcaagaagcgctcctggccgctgaacgaggccgtgatggccgtgggcatggtcagcatcctggcctccagcctcctgaagaacgacatccccatgaccgggcccctggtggccggcgggctcctgacggtgtgctacgtcctgaccggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtgatcagcggggtcttcccggtgtccatccccatcaccgccgcggcctggtacctgtgggaggtgaagaagcagcgcgccggcgtcctgtgggacgtgcccagcccgccgcccgtggagaaggccgagctcgaggacggggcctaccggatcaagcagcgcggcatcctggggtactcccagatcggcgcgggcgtctacaaggaggggaccttccacaccatgtggcacgtgacgcggggcgccgtgctgatgcaccgcgggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttcaagaccaacaccggcacgatcggggcggtgagcctggacttctcccccggcaccagcggctcccccatcgtggaccggaaggggaaggtcgtgggcctctacgggaacggcgtggtcacccgcagcggcgcctacgtgtccgccatcgcccagaccgagaagtccatcgaggacaaccccgagatcgaggacgacatcttccggaagaagcgcctgacgatcatggacctgcaccccggggcgggcaagaccaagcggtacctgcccgccatcgtgcgcgaggccatcaagcgggggctccgcaccctgatcctggccccgacccgcgtcgtggccgcggagatggaggaggccctccggggcctgcccatccgctaccagacgcccgccatccgggccgagcacaccgggcgcgagatcgtggacctgatgtgccacgccaccttcaccatgcggctcctgagccccgtccgcgtgccgaactacaacctgatcatcatggacgaggcgcacttcacggaccccgcctccatcgccgcccggggctacatcagcacccgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtcacggacttcaagggcaagaccgtgtggttcgtgccgtccatcaaggccgggaacgacatcgcggcctgcctccgcaagaacggcaagaaggtcatccagctgagccggaagaccttcgactccgagtacgtgaagacccgcgccaacgactgggacttcgtggtcacgaccgacatcagcgagatgggcgccaacttccgggccgagcgcgtgatcgacccccggcgctgcatgaagcccgtgatcctgaccgacggggaggagcgggtcatcctcgcgggccccatgccggtgacccactccagcgccgcccagcgccgcgggcggatcggccgcaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgggagaaggtggacgcgatcgacggcgagtaccgcctgcgcggggaggcccgcaagaccttcgtcgacctgatgcggcgcggcgacctccccgtgtggctggcctaccgggtggccgccgaggggatcaactacgcggaccgccggtggtgcttcgacggcatcaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcacggagatgggccgcctgcccaccttcatgacccagaaggcccgggacgccctggacaacctcgccgtcctgcacaccgccgaggccggcgggcgcgcctacaaccacgccctgagcgagctccccgagacgctggagaccctgctcctgctgaccctcctggccaccgtgaccggcgggatcttcctgttcctcatgtccgggaaggggatcggcaagatgaccctggggatgtgctgcatcatcaccgccagcatcctgctctggtacgcgcagatccagccgcactggatcgccgcctccatcatcctggagttcttcctgatcgtgctcctgatccccgagcccgagaagcagcggacgccccaggacaaccagctgacctacgtcgtgatcgccatcctcacggtggtcgccgcgaccatggccaacgagatgggcttcctggagaagaccaagaaggacctggggctcggcagcatcaccacgcaggagagcgagtccaacatcctggacatcgacctgcgcccggccagcgcctggaccctctacgccgtggcgaccaccttcgtgacgcccatgctgcggcactccatcgagaacagctccgtcaacgtgagcctgaccgccatcgccaaccaggccaccgtgctcatgggcctggggaagggctggcccctgtccaagatggacatcggggtccccctcctggcgatcggctgctacagccaggtgaacccgatcaccctgacggccgccctcctgctgctcgtggcccactacgccatcatcgggcccggcctgcaggcgaaggccacccgcgaggcccagaagcgcgccgccgcgggcatcatgaagaaccccaccgtcgacgggatcaccgtgatcgacctggagcccatcccgtacgaccccaagttcgagaagcagctcggccaggtgatgctgctgatcctctgcgtcacccaggtgctgatgatgcggaccacctgggccctgtgcgaggccctcaccctggccacggggcccatctccaccctgtgggagggcaaccccgggcgcttctggaacaccaccatcgccgtgagcatggcgaacatcttccggggctcctacctcgccggcgccgggctgctgttcagcatcatgaagaacacgaccaacacccgccggggcaccgggaacatcggcgagacgctcggcgagaagtggaagtcccgcctgaacgccctgggcaagagcgagttccagatctacaagaagtccggcatccaggaggtcgaccggaccctcgcgaaggaggggatcaagcgcggcgagaccgaccaccacgccgtgagccgggggtccgccaagctgcgctggttcgtggagcggaacatggtcaccccggagggcaaggtggtggacctgggctgcgggcgcggcgggtggagctactactgcggcgggctcaagaacgtccgggaggtgaagggcctgacgaagggcgggcccggccacgaggagcccatccccatgtccacctacgggtggaacctggtgcgcctccagagcggcgtcgacgtgttcttcaccccgcccgagaagtgcgacaccctgctgtgcgacatcggggagagctcccccaaccccacgatcgaggccggccggaccctccgcgtgctgaacctggccgagaactggctcaacaacaacacccagttctgcatcaaggtcctgaacccgtacatgcccagcgtgatcgagaagatggagaccctgcagcggaagtacggcggggcgctggtgcgcaaccccctctcccggaacagcacccacgagatgtactgggtctccaacgccacgggcaacatcgtgagctccgtgaacatgatcagccgcatgctgatcaaccgcttcaccatgaagcacaagaaggccacctacgagccggacgtcgacctggggtccggcacccggaacatcgggatcgagagcgagatccccaacctcgacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtggtccggctgctgacgaagccctgggacgtggtgccgatggtcacccagatggcgatgaccgacaccacgcccttcgggcagcagcgcgtgttcaaggagaaggtggacacccggacccaggagcccaaggagggcaccaagaagctcatgcgcatcacggccgagtggctgtggaaggagctgggcaagaagaagacgccccggatgtgcacccgcgaggagttcacccggaaggtccgcagcaacgccgccctcggggccatcttcacggacgagaacaagtggaagtccgcgcgggaggccgtggaggacagccgcttctgggagctggtggaccgggagcgcaacctgcacctcgagggcaagtgcgagacctgcgtctacaacatgatggggaagcgggagaagaagctgggcgagttcgggaaggccaagggctcccgcgccatctggtacatgtggctgggcgcgcggttcctcgagttcgaggccctggggttcctgaacgaggaccactggttcagccgcggcaacagcctctccggggtggagggcgaggggctgcaccggctgggctacatcctccgcgacgtcagcaagaaggagggcggggccatgtacgccgacgacaccgccggctgggacacccggatcacgctggaggacctgaagaacgaggagatggtgaccaaccacatgaagggggagcacaagaagctcgcggaggccatcttcaagctgacctaccagaacaaggtggtccgcgtgcagcgcccgacgccccggggcacggtgatggacatcatctcccgccgggaccagcgcgggagcggccaggtcggcacctacgggctgaacaccttcaccaacatggaggcccagctcatccggcagatggagggcgaggggatcttcaagtccatccagcacctgacggtgaccgaggagatcgccgtgcagaactggctggcccgcgtcggccgggagcgcctcagccggatggcgatctccggcgacgactgcgtggtgaagcccctggacgaccgcttcgccagcgccctgaccgccctcaacgacatggggaaggtccggaaggacatccagcagtgggagccctcccgcggctggaacgactggacccaggtgccgttctgcagccaccacttccacgagctggtgatgaaggacgggcgggtcctggtggtgccctgccgcaaccaggacgagctcatcggccgggcccgcatctcccagggggcgggctggagcctgaaggagacggcctgcctgggcaagtcctacgcccagatgtggaccctcatgtacttccaccggcgcgacctgcggctggccgccaacgcgatctgcagcgccgtcccctcccactgggtgcccaccagccgcaccacctggtccatccacgccaagcacgagtggatgacgaccgaggacatgctcgccgtgtggaaccgcgtctggatccaggagaacccgtggatggaggacaagacccccgtggagagctgggaggaggtgccctacctggggaagcgggaggaccagtggtgcggcagcctgatcgggctcacctcccgcgcgacgtgggccaagaacatccagaccgccatcaaccaggtccggagcctgatcggcaacgaggagtacaccgactacatgccctccatgaagcgcttccggcgcgaggaggaggaggccggggtgctgtgg

SEQ ID NO: 9734 - RNA, 9873 nt, synthetic construct
  misc_feature 1..9873: note = derived and/or modified CDS sequence (opt1) from DENV-2__HQ012536__SS-prME
  source 1..9873: mol_type = other RNA
accgccggcgtgatcatcatgctgatccccaccgccatggcgttccacctcaccacccggaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctgttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggctggacaagctgcagctcaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctggagaagcggcacgtcctggggcgcctcatcacggtgaacccgatcgtgaccggcaaggacagccccgtcaacatcgaggccgagccgcccttcggggactcctacatcatcatcggcgtggagccggggcagctgaagctgaactggttcaagaagggcagctccatcggccagatgttcgagaccaccatgcgcggggccaagcggatggccatcctcggcgacacggcctgggacttcgggagcctgggcggggtgttcacctccatcggcaaggcgctgcaccaggtcttcggcgccatctacggggccgccttcagcggcgtgtcctggaccatgaagatcctgatcggggtgatcatcacctggatcggcatgaacagccgctccacgagcctctccgtcagcctggtgctggtgggggtcgtgaccctctacctgggcgcgatggtgcaggccgactccggctgcgtcgtgagctggaagaacaaggagctgaagtgcgggtccggcatcttcatcaccgacaacgtgcacacctggacggagcagtacaagttccagcccgagagccccagcaagctcgcctccgccatccagaaggcccacgaggaggggatctgcggcatccggagcgtcacccgcctggagaacctgatgtggaagcagatcacccccgagctcaaccacatcctgtccgagaacgaggtgaagctgaccatcatgacgggggacatcaagggcatcatgcaggcgggcaagcggagcctccgcccgcagcccaccgagctgaagtactcctggaagacctgggggaaggccaagatgctgagcaccgagtcccacaaccagacgttcctcatcgacggccccgagaccgccgagtgcccgaacaccaaccgggcctggaacagcctggaggtggaggactacgggttcggcgtcttcaccacgaacatctggctgaagctccgcgagaagcaggacgtgttctgcgactccaagctgatgagcgccgcgatcaaggacaaccgggccgtgcacgccgacatgggctactggatcgagtccgccctgaacgggacctggaagatggagaaggccagcttcatcgaggtcaagtcctgccactggcccaagagccacaccctctggtccaacggcgtgctggagagcgagatgatcatccccaagaacttcgcggggcccgtgtcccagcacaactaccgcccgggctaccacacccagaccgccgggccctggcacctgggcaagctcgagatggacttcgacttctgcgagggcacgaccgtcgtggtgaccgaggactgcgggaaccggggccccagcctgcgcaccacgaccgccagcgggaagctgatcaccgagtggtgctgccggtcctgcaccctcccgcccctgcgctaccggggcgaggacgggtgctggtacggcatggagatccgccccctgaaggagaaggaggagaacctcgtcaacagcctggtgacggccggccacgggcagatcgacaacttctccctgggcgtgctcgggatggcgctgttcctggaggagatgctccggacccgcgtcggcaccaagcacgccatcctgctggtggccgtgagcttcgtcaccctcatcacggggaacatgtccttcaaggacctgggccgggtgatggtgatggtcggcgtggccatgaccgacgacatcgggatgggcgtgacctacctggccctcctggcggccttcaaggtccgccccaccttcgccgccgggctgctcctgcgcaagctgacgagcaaggagctcatgatggccaccatcggcatcaccctgctgtcccagagcaccatccccgagacgatcctcgagctgaccgacgcgctggccctcggcatgatggtgctgaagatcgtgcggaacatggagaagtaccagctggccgtcaccatcatggccatctcctgcgtgcccaacgccgtgatcctcctgaacgcgtggaaggtcagctgcaccatcctggccgccgtgtccgtcagccccctcctgctgacgtccagccagcagaagaccgactggatccccctcgccctgaccatcaaggggctgaaccccaccgcgatcttcctcacgaccctgtcccgcaccagcaagaagcggtcctggccgctgaacgaggccgtgatggccgtgggcatggtcagcatcctcgcctccagcctgctgaagaacgacatccccatgaccgggcccctcgtggccggcgggctgctgacggtgtgctacgtcctcaccggccgcagcgcggacctggagctggagcgggccgccgacgtgaagtgggaggaccaggccgagatctccggcagctcccccatcctcagcatcaccatctccgaggacgggagcatgtccatcaagaacgaggaggaggagcagaccctgacgatcctgatccgcaccggcctcctggtgatcagcggggtcttcccggtgtccatccccatcaccgccgcggcctggtacctgtgggaggtgaagaagcagcgggccggcgtcctctgggacgtgccctccccgccgcccgtggggaaggccgagctggaggacggcgcctaccgcatcaagcagcggggcatcctggggtactcccagatcggcgcgggggtctacaaggagggcaccttccacaccatgtggcacgtgacgcgcggggccgtgctcatgcaccggggcaagcgcatcgagcccagctgggccgacgtcaagaaggacctgatctcctacggcgggggctggaagctggagggggagtggaaggagggcgaggaggtccaggtgctcgccctggagcccgggaagaacccccgggccgtccagaccaagcccggcctgttcaagaccaacaccggcacgatcggggcggtgagcctcgacttctcccccggcaccagcgggtcccccatcgtggaccgcaagggcaaggtcgtgggcctgtacgggaacggcgtggtcacccggagcggggcctacgtgtccgccatcgcccagaccgagaagtccatcgaggacaaccccgagatcgaggacgacatcttccgcaagaagcggctgacgatcatggacctgcaccccggcgcggggaagaccaagcgctacctccccgccatcgtgcgggaggccatcaagcgcggcctgcggaccctgatcctcgccccgacccgcgtcgtggccgcggagatggaggaggccctgcgcggcctgcccatccggtaccagacgcccgccatccgcgccgagcacaccgggcgggagatcgtggacctcatgtgccacgccaccttcaccatgcgcctgctgagccccgtccgggtgccgaactacaacctcatcatcatggacgaggcgcacttcacggaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtcacggacttcaagggcaagaccgtgtggttcgtgccgtccatcaaggccgggaacgacatcgcggcctgcctgcggaagaacggcaagaaggtcatccagctgagccgcaagaccttcgactccgagtacgtgaagacccgggccaacgactgggacttcgtggtcacgaccgacatcagcgagatgggggccaacttccgcgccgagcgggtgatcgacccccgccggtgcatgaagcccgtgatcctcaccgacggcgaggagcgcgtcatcctggcggggcccatgccggtgacccactccagcgccgcccagcggcgcggccgcgtgggccggaaccccaagaacgagaacgaccagtacatctacatgggggagcccctggagaacgacgaggactgcgcccactggaaggaggccaagatgctcctggacaacatcaacacgcccgagggcatcatcccgtccatgttcgagcccgagcgcgagaaggtcgacgcgatcgacggggagtaccggctgcgcggcgaggcccggaagaccttcgtggacctcatgcgccgcggggacctgcccgtgtggctggcctaccgcgtcgccgccgagggcatcaactacgcggaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgccgcgggccgcaagtccctgaccctcaacctgatcacggagatggggcggctgcccaccttcatgacccagaaggcccgcgacgccctcgacaacctggccgtgctgcacaccgccgaggcgggcggccgggcctacaaccacgccctcagcgagctgcccgagacgctggagaccctcctgctgctcaccctgctggccaccgtgaccggcgggatcttcctcttcctgatgtccgggaaggggatcgggaagatgaccctgggcatgtgctgcatcatcaccgccagcatcctcctgtggtacgcgcagatccagccgcactggatcgccgcctccatcatcctggagttcttcctcatcgtcctgctgatccccgagcccgagaagcagcgcacgccccaggacaaccagctcacctacgtggtgatcgccatcctgacggtcgtggccgcgaccatggccaacgagatgggcttcctggagaagaccaagaaggacctcgggctgggcagcatcaccacgcaggagagcgagtccaacatcctggacatcgacctccggccggccagcgcctggaccctgtacgccgtggcgaccaccttcgtcacgcccatgctgcgccactccatcgagaacagctccgtgaacgtgagcctcaccgccatcgccaaccaggccaccgtcctgatggggctgggcaaggggtggcccctctccaagatggacatcggcgtgcccctgctggcgatcggctgctacagccaggtgaacccgatcaccctcacggccgccctgctgctcctggtcgcccactacgccatcatcgggcccggcctgcaggcgaaggccacccgggaggcccagaagcgcgccgccgcggggatcatgaagaaccccaccgtggacggcatcaccgtgatcgacctcgagcccatcccgtacgaccccaagttcgagaagcagctggggcaggtcatgctgctcatcctgtgcgtgacccaggtgctgatgatgcgcaccacctgggccctctgcgaggccctgaccctggccacgggccccatctccaccctctgggagggcaaccccgggcggttctggaacaccaccatcgccgtcagcatggcgaacatcttccgcggctcctacctggccggggccggcctcctcttcagcatcatgaagaacacgaccaacacccggcgcggcaccgggaacatcggcgagacgctgggggagaagtggaagtcccggctgaacgccctcggcaagagcgagttccagatctacaagaagtccgggatccaggaggtggaccgcaccctggcgaaggagggcatcaagcggggcgagaccgaccaccacgccgtgagccgcgggtccgccaagctgcggtggttcgtcgagcgcaacatggtgaccccggagggcaaggtggtcgacctcgggtgcggccgcggcgggtggagctactactgcggcgggctgaagaacgtgcgcgaggtgaaggggctgacgaagggcggccccgggcacgaggagcccatccccatgtccacctacggctggaacctcgtccggctgcagagcggcgtggacgtgttcttcaccccgcccgagaagtgcgacaccctgctctgcgacatcggggagagctcccccaaccccacgatcgaggccggccgcaccctgcgggtcctgaacctcgtggagaactggctgaacaacaacacccagttctgcatcaaggtgctgaacccgtacatgcccagcgtcatcgagaagatggagaccctgcagcgcaagtacgggggcgccctcgtgcggaaccccctgtcccgcaacagcacccacgagatgtactgggtgtccaacgcgacggggaacatcgtcagctccgtgaacatgatcagccggatgctgatcaaccgcttcaccatgaagcacaagaaggccacctacgagccggacgtggacctcggctccggcacccgcaacatcgggatcgagagcgagatccccaacctggacatcatcggcaagcggatcgagaagatcaagcaggagcacgagacgtcctggcactacgaccaggaccacccctacaagacctgggcctaccacgggagctacgagaccaagcagaccggctccgccagctccatggtcaacggcgtggtgcgcctgctcacgaagccctgggacgtcgtgccgatggtgacccagatggccatgaccgacaccacgcccttcgggcagcagcgggtcttcaaggagaaggtggacacccgcacccaggagcccaaggagggcaccaagaagctgatgcggatcacggcggagtggctgtggaaggagctcgggaagaagaagacgccccgcatgtgcacccgggaggagttcacccgcaaggtgcggagcaacgccgccctgggcgccatcttcacggacgagaacaagtggaagtccgcccgcgaggcggtcgaggacagccggttctgggagctggtggaccgcgagcggaacctccacctggaggggaagtgcgagacctgcgtctacaacatgatgggcaagcgcgagaagaagctgggcgagttcgggaaggccaagggctcccgggccatctggtacatgtggctcggggcccgcttcctggagttcgaggcgctgggcttcctcaacgaggaccactggttcagccgggggaacagcctgtccggcgtggagggcgaggggctgcaccgcctcggctacatcctgcgggacgtgagcaagaaggagggcggcgccatgtacgccgacgacaccgccgggtgggacacccgcatcacgctggaggacctcaagaacgaggagatggtcaccaaccacatgaagggcgagcacaagaagctggccgaggcgatcttcaagctgacctaccagaacaaggtggtgcgggtccagcgcccgacgccccgcggcaccgtgatggacatcatctcccggcgcgaccagcgggggagcggccaggtggggacctacggcctcaacaccttcaccaacatggaggcccagctgatccgccagatggagggcgaggggatcttcaagtccatccagcacctgacggtcaccgaggagatcgccgtgcagaactggctcgcccgggtgggccgcgagcggctgagccgcatggccatctccggggacgactgcgtcgtgaagcccctggacgaccggttcgcgagcgccctcaccgccctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcggccgcgcccggatctcccagggggccggctggagcctgaaggagacggcgtgcctcgggaagtcctacgcccagatgtggaccctgatgtacttccaccgccgggacctgcgcctcgccgccaacgccatctgcagcgcggtgccctcccactgggtccccaccagccggaccacctggtccatccacgccaagcacgagtggatgacgaccgaggacatgctggccgtgtggaaccgcgtgtggatccaggagaacccgtggatgggcgacaagacccccgtcgagagctgggaggaggtgccctacctggggaagcgcgaggaccagtggtgcggcagcctcatcggcctgacctcccgggccacgtgggcgaagaacatccagaccgccatcaaccaggtgcgcagcctgatcgggaacgaggagtacaccgactacatgccctccatgaagcggttccgccgggaggaggaggaggccggcgtcctctgg

SEQ ID NO: 9735 - RNA, 9873 nt, synthetic construct
  misc_feature 1..9873: note = derived and/or modified CDS sequence (opt1) from DENV-2__HQ012537__SS-prME
  source 1..9873: mol_type = other RNA
accgcgggcgtgatcatcatgctgatccccaccgcgatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccgcaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatgacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggtgaccatgaccgacgacatcggcatgggcgtgacctacctggccctgctcgccgcgttcaaggtccgccccacgttcgccgccgggctgctgctccggaagctgaccagcaaggagctgatgatggccaccatcggcatcgccctcctgtcccagagcaccatccccgagacgatcctggagctcaccgacgcgctggccctggggatgatggtgctccgcatcgtgcggaacatggagaagtaccagctggccgtcaccatcatggccatctcctgcgtgccgaacgccgtgatcctgctcaacgcgtggaaggtcagctgcaccatcctggccgccgtgtccgtcagccccctgctcctgacgtccagccagcagaagaccgactggatccccctggccctcaccatcaagggcctgaaccccaccgcgatcttcctgacgaccctctcccgcaccagcaagaagcggtcctggccgctgaacgaggccgtgatggccgtgggcatggtcagcatcctggcctccagcctcctgaagaacgacatccccatgaccgggcccctggtggccggcgggctcctgacggtgtgctacgtcctgaccggccgcagcgcggacctcgagctggagcgggccgccgacgtgaagtgggaggaccaggccgagatctccgggagctcccccatcctgagcatcaccatctccgaggacggcagcatgtccatcaagaacgaggaggaggagcagaccctcacgatcctgatccgcaccggcctgctcgtgatcagcggggtcttcccggtgtccatccccatcaccgccgcggcctggtacctgtgggaggtgaagaagcagcgggccggcgtcctgtgggacgtgcccagcccgccgcccgtggagaaggccgagctcgaggacggggcctaccgcatcaagcagcggggcatcctggggtactcccagatcggcgcgggcgtctacaaggaggggaccttccacaccatgtggcacgtgacgcgcggcgccgtgctgatgcaccgggggaagcgcatcgagcccagctgggccgacgtcaagaaggacctcatctcctacggcgggggctggaagctggagggcgagtggaaggagggggaggaggtccaggtgctggccctcgagcccggcaagaacccccgggccgtccagaccaagcccgggctgttcaagaccaacaccggcacgatcggggcggtgagcctggacttctcccccggcaccagcggctcccccatcgtggaccgcaaggggaaggtcgtgggcctctacgggaacggcgtggtcacccggagcggcgcctacgtgtccgccatcgcccagaccgagaagtccatcgaggacaaccccgagatcgaggacgacatcttccgcaagaagcggctgacgatcatggacctgcaccccggggcgggcaagaccaagcgctacctgcccgccatcgtgcgggaggccatcaagcgcgggctccgcaccctgatcctggccccgacccgggtcgtggccgcggagatggaggaggccctccgcggcctgcccatccggtaccagacgcccgccatccgcgccgagcacaccgggcgggagatcgtggacctgatgtgccacgccaccttcaccatgcgcctcctgagccccgtccgggtgccgaactacaacctgatcatcatggacgaggcgcacttcacggaccccgcctccatcgccgcccgcggctacatcagcacccgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtcacggacttcaagggcaagaccgtgtggttcgtgccgtccatcaaggccgggaacgacatcgcggcctgcctccggaagaacggcaagaaggtcatccagctgagccgcaagaccttcgactccgagtacgtgaagacccgggccaacgactgggacttcgtggtcacgaccgacatcagcgagatgggcgccaacttccgcgccgagcgggtgatcgacccccgccggtgcatgaagcccgtgatcctgaccgacggggaggagcgcgtcatcctcgcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgcgagaaggtggacgcgatcgacggcgagtaccggctgcgcggggaggcccggaagaccttcgtcgacctgatgcgccggggcgacctccccgtgtggctggcctaccgcgtggccgccgaggggatcaactacgcggaccggcgctggtgcttcgacggcatcaagaacaaccagatcctggaggagaacgtcgaggtggagatctggaccaaggagggggagcggaagaagctcaagccgcgctggctggacgcccggatctacagcgaccccctggccctcaaggagttcaaggagttcgccgcgggccgcaagtccctgaccctgaacctcatcacggagatgggccggctgcccaccttcatgacccagaaggcccgcgacgccctggacaacctcgccgtcctgcacaccgccgaggccggcgggcgggcctacaagcacgccctgagcgagctccccgagacgctggagaccctgctcctgctgaccctcctggccaccgtgaccggcgggatcttcctgttcctcatgtccgggaaggggatcggcaagatgaccctggggatgtgctgcatcatcaccgccagcatcctgctctggtacgcgcagatccagccgcactggatcgccgcctccatcatcctggagttcttcctgatcgtgctcctgatccccgagcccgagaagcagcgcacgccccaggacaaccagctgacctacgtcgtgatcgccatcctcacggtggtcgccgcgaccatggccaacgagatgggcttcctggagaagaccaagaaggacctggggctcggcagcatcaccacgcaggagagcgagtccaacatcctggacatcgacctgcggccggccagcgcctggaccctctacgccgtggcgaccaccttcgtgacgcccatgctgcgccactccatcgagaacagctccgtcaacgtgagcctgaccgccatcgccaaccaggccaccgtgctcatgggcctggggaagggctggcccctgtccaagatggacatcggggtccccctcctggcgatcggctgctacagccaggtgaacccgatcaccctgacggccgccctcctgctgctcgtggcccactacgccatcatcgggcccggcctgcaggcgaaggccacccgcgaggcccagaagcgggccgccgcgggcatcatgaagaaccccaccgtcgacgggatcaccgtgatcgacctggagcccatcccgtacgaccccaagttcgagaagcagctcggccaggtgatgctgctgatcctctgcgtcacccaggtgctgatgatgcgcaccacctgggccctgtgcgaggccctcaccctggccacggggcccatctccaccctgtgggagggcaaccccgggcggttctggaacaccaccatcgccgtgagcatggcgaacatcttccgcggctcctacctcgccggcgccgggctgctgttcagcatcatgaagaacacgaccaacacccggcgcggcaccgggaacatcggcgagacgctcggcgagaagtggaagtcccggctgaacgccctgggcaagagcgagttccagatctacaagaagtccggcatccaggaggtcgaccgcaccctcgcgaaggaggggatcaagcggggcgagaccgaccaccacgccgtgagccgcgggtccgccaagctgcggtggttcgtggagcgcaacatggtcaccccggagggcaaggtggtggacctgggctgcgggcggggcgggtggagctactactgcggcgggctcaagaacgtccgcgaggtgaagggcctgacgaagggcgggcccggccacgaggagcccatccccatgtccacctacgggtggaacctggtgcggctccagagcggcgtcgacgtgttcttcaccccgcccgagaagtgcgacaccctgctgtgcgacatcggggagagctcccccaaccccacgatcgaggccggccgcaccctccgggtgctgaacctggccgagaactggctcaacaacaacacccagttctgcatcaaggtcctgaacccgtacatgcccagcgtgatcgagaagatggagaccctgcagcgcaagtacggcggggcgctggtgcggaaccccctctcccgcaacagcacccacgagatgtactgggtctccaacgccacgggcaacatcgtgagctccgtgaacatgatcagccgcatgctgatcaaccggttcaccatgaagcacaagaaggccacctacgagccggacgtcgacctggggtccggcacccgcaacatcgggatcgagagcgagatccccaacctcgacatcatcggcaagcggatcgagaagatcaagcaggagcacgagacgtcctggcactacgaccaggaccacccctacaagacctgggcctaccacggcagctacgagaccaagcagaccgggtccgccagctccatggtgaacggcgtggtccgcctgctgacgaagccctgggacgtggtgccgatggtcacccagatggcgatgaccgacaccacgcccttcgggcagcagcgggtgttcaaggagaaggtggacacccgcacccaggagcccaaggagggcaccaagaagctcatgcggatcacggccgagtggctgtggaaggagctgggcaagaagaagacgccccgcatgtgcacccgggaggagttcacccgcaaggtccggagcaacgccgccctcggggccatcttcacggacgagaacaagtggaagtccgcgcgcgaggccgtggaggacagccggttctgggagctggtggaccgcgagcggaacctgcacctcgagggcaagtgcgagacctgcgtctacaacatgatggggaagcgcgagaagaagctgggcgagttcgggaaggccaagggctcccgggccatctggtacatgtggctgggcgcgcgcttcctcgagttcgaggccctggggttcctgaacgaggaccactggttcagccggggcaacagcctctccggggtggagggcgaggggctgcaccgcctgggctacatcctccgggacgtcagcaagaaggagggcggggccatgtacgccgacgacaccgccggctgggacacccgcatcacgctggaggacctgaagaacgaggagatggtgaccaaccacatgaagggggagcacaagaagctcgcggaggccatcttcaagctgacctaccagaacaaggtggtccgcgtgcagcggccgacgccccgcggcacggtgatggacatcatctcccggaaggaccagcgcgggagcggccaggtcggcacctacgggctgaacaccttcaccaacatggaggcccagctcatccggcagatggagggcgaggggatcttcaagtccatccagcacctgacggtgaccgaggagatcgccgtgcagaactggctggcccgcgtcggccgggagcgcctcagccggatggcgatctccggcgacgactgcgtggtgaagcccctggacgaccgcttcgccagcgccctgaccgccctcaacgacatggggaaggtccggaaggacatccagcagtgggagccctcccgcggctggaacgactggacccaggtgccgttctgcagccaccacttccacgagctggtgatgaaggacgggcgggtcctggtggtgccctgccgcaaccaggacgagctcatcggccgggcccgcatctcccagggggcgggctggagcctgaaggagacggcctgcctgggcaagtcctacgcccagatgtggaccctcatgtacttccaccggcgcgacctgcggctggccgccaacgcgatctgcagcgccgtcccctcccactgggtgcccaccagccgcaccacctggtccatccacgccaagcacgagtggatgacgaccgaggacatgctcgccgtgtggaaccgcgtctggatccaggagaacccgtggatggaggacaagacccccgtggagagctgggaggaggtgccctacctggggaagcgggaggaccagtggtgcggcagcctgatcgggctcacctcccgcgcgacgtgggccaagaacatccagaccgccatcaaccaggtccggagcctgatcggcaacgaggagtacaccgactacatgccctccatgaagcgcttccggcgcgaggaggaggaggccggggtgctgtgg

SEQ ID NO: 9736 - RNA, 9876 nt, synthetic construct
  misc_feature 1..9876: note = derived and/or modified CDS sequence (opt1) from DENV-2__KU365901__SS-prME
  source 1..9876: mol_type = other RNA
accgccggcatcatcatcatgatgatccccaccgtgatggccttccacctgaccacccggaacggggagccccacatgatcgtcagccggcaggagaagggcaagtccctcctgttcaagaccgagaacggggtgaacatgtgcaccctgatggcgatggacctcggcgagctgtgcgaggacaccatcacctacaactgccccctgctccggcagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgccccacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccaggagctcaaccacatcctgtccgagaacgaggtcaagctgaccatcatgacgggggacatcaagggcatcatgcaggccgggaagcggagcctccgcccccagccgaccgagctgaagtactcctggaagacctggggcaaggcgaagatgctgagcaccgagctccacaaccacacgttcctgatcgacggccccgagaccgccgagtgccccaacaccaaccgggcctggaactccctggaggtggaggactacgggttcggcgtgttcaccacgaacatctggctcaagctgaaggagaagcaggacgtcttctgcgacagcaagctgatgtccgccgccatcaaggacaaccgcgcggtgcacgccgacatggggtactggatcgagagcgccctcaacgacacctggaagatcgagaaggcctccttcatcgaggtcaagagctgcaactggccgaagtcccacaccctgtggagcaacggcgtgctggagtccgagatgatcatccccaagaacttcgccggccccgtgagccagcacaactaccggcccgggtaccacacccagaccgcgggcccgtggcacctcgggcgcctggagatggacttcgagttctgcgagggcacgaccgtggtcgtgaccgaggactgcgggaaccggggccccagcctgcgcaccacgaccgcctccggcaagctcatcaccgagtggtgctgccggagctgcaccctgccgcccctgcgctaccgcggggaggacggctgctggtacgggatggagatccgcccgctcaaggagaaggaggagaacctggtgaactccctggtcacggccggccacgggcagatcgacaacttcagcctcggcgtgctgggcatggccctgttcctcgaggagatgctgcggacccgcgtggggaccaagcacgcgatcctgctcgtcgccgtgaccttcgtgacgctgatcaccggcaacatgtccttccgggacctggggcgcgtcatggtgatggtgggcgccaccatgaccgacgacatcgggatgggcgtcacgtacctcgccctgctggccgcgttcaaggtgcgccccaccttcgccgccggcctcctgctgcggaagctcaccagcaaggagctgatgatggccaccatcgggatcgtgctgctctcccagagcacgatccccgagaccatcctggagctgaccgacgccctcgcgctgggcatgatggtcctgaagatcgtgcgcaacatggagaagtaccagctcgccgtcaccatcatggccatcctgtgcgtgcccaacgccgtgatcctgcagaacgcctggcgggtctcctgcacgaccctcgcggtggtgagcgtctccccgctgctgctcaccagctcccagcagaaggccgactggatccccctggccctgaccatcaaggggctcaaccccacggccatcttcctgaccaccctgagccgcacctccaagaagcggagctggcccctcaacgaggcgatcatggccgtgggcatggtgtccatcctggccagctccctgctcaagaacgacatcccgatgacgggccccctggtcgccgggggcctgctcaccgtgtgctacgtgctgaccgggcgcagcgccgacctggagctcgagcgggcggccgacgtccgctgggaggagcaggccgagatcagcggctccagccccatcctgtccatcaccatcagcgaggacgggtccatgagcatcaagaacgaggaggaggagcagacgctgaccatcctcatccggaccggcctgctggtgatctccggcctcttccccgtgagcatcccgatcaccgccgccgcgtggtacctgtgggaggtcaagaagcagcgcgccggggtgctgtgggacgtgcccagcccgccgcccgtcggcaaggccgagctcgaggacggggcctaccggatcaagcagaagggcatcctggggtacagccagatcggcgccggcgtgtacaaggaggggaccttccacacgatgtggcacgtgacccgcggcgcggtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccccgcgccgtgcagaccaagcccgggctgttcaagaccaacacgggcaccatcggggccgtgtccctggacttcagccccggcacctccggcagccccatcgtcgacaagaaggggaaggtggtgggcctctacgggaacggcgtcgtgacccggtccggcacgtacgtgagcgcgatcgcccagaccgagaagtccatcgaggacaacccggagatcgaggacgacatcttccgcaagaagcggctgaccatcatggacctgcaccccggggccggcaagaccaagcgctacctgcccgccatcgtccgggaggcgatcaagcgcgggctccggacgctgatcctggcccccacccgcgtggtggccgccgagatggaggaggccctccgcggcctgccgatccggtaccagacccccgcgatccgcgccgagcacaccgggcgggagatcgtcgacctgatgtgccacgccacgttcaccatgcgcctcctgagccccatccgggtgcccaactacaacctgatcatcatggacgaggcccacttcaccgacccggccagcatcgcggcccgcggctacatctccacccgggtggagatgggcgaggccgccgggatcttcatgacggccacgccgcccggcagccgcgaccccttcccgcagtccaacgcgcccatcatggacgaggagcgggagatccccgagcgcagctggaactccgggcacgagtgggtcaccgacttcaagggcaagaccgtgtggttcgtgcccagcatcaaggccgggaacgacatcgccgcctgcctccggaagaacggcaagaaggtcatccagctgtcccgcaagacgttcgacagcgagtacatcaagacccggaccaacgactgggacttcgtggtgaccacggacatctccgagatgggcgcgaacttcaaggccgagcgcgtcatcgacccgcggcgctgcatgaagcccgtgatcctgaccgacggggaggagcgggtgatcctcgccggccccatgcccgtcacccacagctccgccgcccagcgccgggggcgcgtgggccgcaacccgaagaacgagaacgaccagtacatctacatgggggagcccctggagaacgacgaggactgcgcgcactggaaggaggccaagatgctgctcgacaacatcaacacccccgagggcatcatccccagcatgttcgagccggagcgggagaaggtggacgccatcgacggcgagtaccgcctgcgcggggaggcccgcaagacgttcgtcgacctgatgcggcgcggcgacctccccgtgtggctggcctaccgggtcgcggccgaggggatcaactacgccgaccgccggtggtgcttcgacggcgtgaagaacaaccagatcctggaggagaacgtggaggtcgagatctggaccaaggagggggagcgcaagaagctcaagccccggtggctggacgcccgcatctactccgacccgctggccctcaaggagttcaaggagttcgcggccggccgcaagagcctgaccctgaacctcatcaccgagatgggccggctgcccacgttcatgacccagaaggcccggaacgccctggacaacctcgcggtgctgcacaccgccgaggccgggggccgcgcctacaaccacgccctgtccgagctccccgagaccctggagacgctgctcctgctgaccctcctggcgaccgtgaccgggggcatcttcctgttcctcatgagcggcaaggggatcggcaagatgaccctggggatgtgctgcatcatcacggcctccatcctgctctggtacgcccagatccagccccactggatcgccgccagcatcatcctggagttcttcctgatcgtcctcctgatcccggagcccgagaagcagcggacgccccaggacaaccagctgacctacgtggtgatcgcgatcctcaccgtcgtggccgccacgatggccaacgagatgggcttcctggagaagaccaagaaggacttcgggctgggctccatcaccacccagcagcccgagagcaacatcctcgacatcgacctgcgcccggccagcgcgtggacgctgtacgccgtggccaccaccttcatcacccccatgctccggcactccatcgagaacagctccgtcaacgtgagcctgacggccatcgccaaccaggcgaccgtgctgatgggcctcgggaagggctggcccctgtccaagatggacatcggggtccccctgctcgccatcggctgctacagccaggtgaacccgatcaccctgaccgccgccctgctcctgctggtggcgcactacgccatcatcgggcccggcctccaggccaaggccacgcgcgaggcccagaagcgggcggccgccggcatcatgaagaaccccaccgtcgacgggatcaccgtgatcgacctggaccccatcccgtacgaccccaagttcgagaagcagctgggccaggtgatgctcctggtcctgtgcgtgacccaggtgctcatgatgcgcacgacctgggccctgtgcgaggccctgaccctcgcgaccgggcccatctccacgctgtgggagggcaaccccgggcgcttctggaacaccaccatcgccgtcagcatggccaacatcttccggggctcctacctggccggcgccgggctcctgttcagcatcatgaagaacaccgcgaacacgcgccggggcaccgggaacaccggcgagaccctgggcgagaagtggaagaaccgcctcaacgccctggggaagtccgagttccagatctacaagaagtccggcatccaggaggtggaccggacgctggccaaggaggggatcaagcgcggcgagaccgaccaccacgccgtgtcccgggggagcgcgaagctccgctggttcgtcgagcggaacctggtgaccccggagggcaaggtggtcgacctgggctgcgggcgcggcgggtggtcctactactgcggcgggctcaagaacgtgaaggaggtgaagggcctgaccaagggcgggcccggccacgaggagcccatccccatgagcacgtacgggtggaacctggtccggctccagtccggcgtggacgtgttcttcaccccgcccgagaagtgcgacaccctgctgtgcgacatcggggagagctcccccaaccccaccgtcgaggccggccgcaccctccgggtgctgaacctggtggagaactggctcaacaacaacacgcagttctgcatcaaggtcctgaacccgtacatgcccagcgtgatcgagaagatggaggccctgcagcgcaagtacggcggggccctggtgcggaaccccctcagccgcaactccacccacgagatgtactgggtcagcaacgcctccggcaacatcgtgagctccgtgaacatgatcagccggatgctgatcaaccgcttcaccatgcggcacaagaaggcgacctacgagccggacgtcgacctggggtccggcacgcgcaacatcgggatcgagagcgagacccccaacctcgacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtggtccggctgctgaccaagccctgggacgtgatcccgatggtgacccagatggccatgacggacaccacccccttcgggcagcagcgcgtcttcaaggagaaggtggacacccggacgcaggagcccaaggagggcaccaagaagctcatgaagatcaccgccgagtggctgtggaaggagctgggccgcaagaagacgccccggatgtgcacgcgcgaggagttcacccggaaggtccgcagcaacgcggccctcggggccatcttcaccgacgagaacaagtggaagtccgcccgggaggccgtggaggacagcggcttctgggagctggtggacaaggagcgcaacctgcacctcgaggggaagtgcgagacctgcgtctacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaactccctcagcggggtggagggcgaggggctgcacaagctgggctacatcctccgggacgtgagcaagaaggagggcggggcgatgtacgccgacgacacggccggctgggacacccgcatcaccctggaggacctgaagaacgaggagatggtcaccaaccacatggagggggagcacaagaagctcgccgaggccatcttcaagctgacgtaccagaacaaggtggtgcgggtccagcgcccgacgccccggggcaccgtgatggacatcatctcccgccgggaccagcgcgggagcggccaggtggtcacctacggcctgaacaccttcaccaacatggaggcgcagctcatccgccagatggagggggagggcgtgttcaagtccatccagcagctgaccgtgaccgaggagatcgccgtcaagaactggctggcccgggtggggcgcgagcggctcagccgcatggccatctccggcgacgactgcgtggtcaagcccctggacgaccggttcgccagcgcgctgacggccctcaacgacatgggcaaggtgcgcaaggacatccagcagtgggagccctcccgggggtggaacgactggacccaggtgccgttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcgcagatgtggagcctcatgtacttccaccggcgcgacctgcggctggccgccaacgccatctgctccgccgtccccagccactgggtgcccacctcccgcaccacgtggagcatccacgcgacccacgagtggatgaccaccgaggacatgctcacggtgtggaaccgggtctggatccaggagaacccgtggatggaggacaagacccccgtggagtcctgggaggagatcccctacctgggcaagcgcgaggaccagtggtgcgggagcctgatcggcctcaccagccgggccacctgggccaagaacatccagacggccatcaaccaggtgcgctccctgatcgggaacgaggagtacaccgactacatgcccagcatgaagcgcttccggcgcgaggaggaggaggcgggcgtcctgtggtga

SEQ ID NO: 9737 - RNA, 9876 nt, synthetic construct
  misc_feature 1..9876: note = derived and/or modified CDS sequence (opt1) from DENV-2__GQ398258__SS-prME
  source 1..9876: mol_type = other RNA
accgccgggatgatcatcatgctgatccccaccgtgatggccttccacctcaccacccgcaacggggagccccacatgatcgtgagccggcaggagaagggcaagagcctgctgttcaagaccgaggacggggtgaacatgtgcaccctcatggcgatggacctgggcgagctgtgcgaggacaccatcacctacaactgccccctcctgcgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcccagcggatcgagacctggatcctgcgccaccccgggttcaccatcatggcggccatcctggcctacaccatcggcaccacctacttccagcgggtcctcatcttcatcctgctgacggccgtggcgccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggccaagctgaccaacacgaccaccgcgagccggtgccccacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaaggtggtgcagcccgagaacctggagtacaccatcgtcatcacgccccactccggcgaggagaacgccgtggggaacgacacgggcaagcacgggaaggagatcaagatcaccccgcagagctccatcaccgaggccgagctgaccggctacgggaccgtgacgatggagtgcagcccccgcaccggcctcgacttcaacgagatggtcctgctgcagatggagaacaaggcctggctcgtgcaccggcagtggttcctggacctgcccctcccctggctgccgggcgcggacacccaggggtccaactggatccagaaggagaccctggtgacgttcaagaacccccacgccaagaagcaggacgtcgtggtcctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctggagaagcggcacgtgctcggccgcctgatcacggtcaacccgatcgtgaccgagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgccaagcggatggccatcctgggcgacacggcctgggacttcgggtccctgggcggggtgttcaccagcatcggcaaggcgctccaccaggtgttcggggccatctacggcgccgccttctccggcgtcagctggaccatgaagatcctgatcggggtggtgatcacctggatcggcatgaactcccgcagcacgtccctgagcgtctccctggtgctcgtgggggtcgtgaccctgtacctgggcgtgatggtccaggcggacagcgggtgcgtggtgtcctggaagaacaaggagctcaagtgcggcagcggcatcttcatcaccgacaacgtccacacctggacggagcagtacaagttccagcccgagagcccctccaagctggccagcgccatccagaaggcccacgaggaggggatctgcggcatccggtccgtgacccgcctggagaacctcatgtggaagcagatcacccccgagctgaaccacatcctgagcgagaacgaggtgaagctcaccatcatgacgggggacatcaagggcatcatgcaggccgggaagcggtccctgcgcccgcagcccaccgagctgaagtacagctggaagacctggggcaaggcgaagatgctctccaccgagctgcacaaccagacgttcctgatcgacggccccgagaccgccgagtgcccgaacaccaaccgggcctggaacagcctcgaggtcgaggactacgggttcggcgtgttcaccacgaacatctggctgaagctgaaggagcgccaggacgtgttctgcgaccccaagctcatgtccgccgccatcaaggacaaccgggcggtccacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggcccggtgagccagcacaactaccgccccgggtaccacacccagaccgcgggcccctggcacctggggaagctggagatggacttcgacttctgcgagggcacgaccgtggtggtcaccgaggactgcgggaaccggggcccctccctccgcaccacgaccgccagcggcaagctgatcaccgagtggtgctgccggagctgcaccctgccgcccctccgctacaagggggaggacggctgctggtacgggatggagatccggcccctgaaggagaaggaggagaacctggtgaactccctcgtgacggccggccacgggcagatcgacaacttcagcctgggcgtcctgggcatggccctcttcctggaggagatgctgcgcacccgggtggggaccaagcacgcgatcctcctggtggccgtctccttcgtgaccctgatcacgggcaacatgagcttccgcgacctcgggcgggtgatggtcatggtgggcgccaccatgaccgacgacatcgggatgggcgtgacctacctggccctgctcgccgcgttcaaggtccgccccacgttcgccgccggcctgctgctccgcaagctgacctccaaggagctgatgatgaccaccatcgggatcgtgctcctgagccagtccacgatcccggagaccatcctggagctcaccgacgccctggccctgggcatgatggtgctcaagatcgtcaagaacatggagaagtaccagctggcggtgaccatcatggccatcctgtgcgtccccaacgccgtgatcctccagaacgcctggaaggtgagctgcacgatcctggccgtcgtgtccgtgagccccctgctcctgacctccagccagcagaaggcggactggatccccctggccctcaccatcaaggggctgaacccgaccgccatcttcctgacgaccctctcccggaccagcaagaagcgctcctggcccctgaacgaggccatcatggcggtcggcatggtgagcatcctggcctccagcctcctgaagaacgacatccccatgaccggccccctggtggccgggggcctcctgacggtctgctacgtgctgaccgggcggtccgccgacctcgagctggagcgcgccgcggacgtgcggtgggaggaccaggccgagatcagcggcagctccccgatcctgagcatcaccatctccgaggacgggagcatgtccatcaagaacgaggaggaggagcagaccctcacgatcctgatccgcaccggcctgctcgtcatcagcggcctgttccccgtgtccatccccatcaccgccgccgcctggtacctgtgggaggtgaagaagcagcgggcgggggtcctctgggacgtgcccagcccgccgcccgtgggcaaggccgagctggaggacggggcctaccgcatcaagcagaagggcatcctggggtactcccagatcggcgccggcgtctacaaggaggggaccttccacaccatgtggcacgtgacgcggggcgccgtgctcatgcacaaggggaagcgcatcgagccgagctgggcggacgtcaagaaggacctgatctcctacggcgggggctggaagctggagggcgagtggaaggagggggaggaggtccaggtgctcgccctggagcccggcaagaacccccgggccgtccagaccaagcccgggctgttcaagaccaacaccggcacgatcggggccgtgagcctcgacttctccccgggcaccagcggctcccccatcgtggacaagaaggggaaggtcgtgggcctgtacgggaacggcgtggtcacccgcagcggcacctacgtgtccgccatcgcgcagacggagaagtccatcgaggacaaccccgagatcgaggacgacatcttccggaagaagcgcctgaccatcatggacctgcaccccggggccggcaagaccaagcggtacctcccggccatcgtgcgcgaggccatcaagcgggggctgcgcaccctgatcctcgcgcccacgcgggtcgtggccgccgagatggaggaggccctgcgcggcctgcccatccggtaccagacccccgccatccgcgcggagcacaccgggcgcgagatcgtggacctcatgtgccacgccaccttcacgatgcggctgctgtccccggtccgcgtgcccaactacaacctcatcatcatggacgaggcccacttcaccgaccccgccagcatcgccgcgcggggctacatcagcacccgcgtggagatgggcgaggccgccgggatcttcatgaccgccacgcccccgggctcccgggaccccttcccccagagcaacgcccccatcatggacgaggagcgcgagatcccggagcggtcctggaacagcgggcacgagtgggtcaccgacttcaagggcaagaccgtgtggttcgtgccctccatcaaggcggggaacgacatcgccgcctgcctgcgcaagaacggcaagaaggtcatccagctgagccggaagaccttcgactccgagtacatcaagacgcgcaccaacgactgggacttcgtggtgaccaccgacatcagcgagatgggcgccaacttcaaggcggagcgggtcatcgacccccgccggtgcatgaagcccgtgatcctcacggacggggaggagcgcgtgatcctggccggcccgatgcccgtcacccactccagcgccgcccagcggcgcgggcggatcggccgcaaccccaagaacgagaacgaccagtacatctacatgggggagcccctggagaacgacgaggactgcgcccactggaaggaggcgaagatgctcctggacaacatcaacaccccggagggcatcatcccctccatgttcgagcccgagcgggagaaggtggacgccatcgacggcgagtaccgcctgcgcggggaggcccggaagaccttcgtggacctcatgcgccggggcgacctgccggtctggctggcctaccgcgtggccgcggaggggatcaactacgccgaccggcgctggtgcttcgacggcatcaagaacaaccagatcctcgaggagaacgtcgaggtggagatctggacgaaggagggggagcggaagaagctgaagccccgctggctggacgcccggatctacagcgaccccctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgcggaggccgggggccgggcctacaaccacgccctcagcgagctgccggagaccctggagaccctcctgctgctcacgctgctggccaccgtcaccgggggcatcttcctcttcctgatgtccggcaaggggatcggcaagatgaccctggggatgtgctgcatcatcaccgcgagcatcctcctgtggtacgcccagatccagccccactggatcgccgcctccatcatcctggagttcttcctcatcgtgctgctgatccccgagcccgagaagcagcgcacgccgcaggacaaccagctcacctacgtggtcatcgccatcctgaccgtggtggcggccaccatggccaacgagatgggcttcctggagaagacgaagaaggacttcgggctcggcagcatcgccacccaccagcccgagtccaacatcctggacatcgacctgcggcccgccagcgcgtggaccctctacgccgtcgccaccacgttcatcacccccatgctgcgccacagcatcgagaactccagcgtgaacgtgtccctgaccgccatcgccaaccaggcgaccgtcctcatgggcctggggaagggctggccgctgagcaagatggacatcggggtgcccctcctggccatcggctgctactcccaggtgaaccccatcacgctgaccgccgccctcctgctgctcgtcgcgcactacgccatcatcgggcccggcctgcaggccaaggccacccgggaggcccagaagcgcgcggccgccggcatcatgaagaacccgaccgtggacgggatcacggtgatcgacctggaccccatcccctacgaccccaagttcgagaagcagctcggccaggtcatgctgctggtgctctgcgtgacccaggtcctgatgatgcggaccacctgggccctgtgcgaggccctcacgctggcgaccgggccgatcagcaccctgtgggagggcaaccccgggcgcttctggaacaccacgatcgccgtgtccatggccaacatcttccggggcagctacctcgccggcgccgggctgctgttctccatcatgaagaacaccgcgaacacccgccgcggcaccgggaacacgggcgagaccctcggcgagaagtggaagaaccggctgaacgccctgggcaagagcgagttccagatctacaagaagtccggcatccaggaggtggaccgcaccctcgccaaggaggggatcaagcggggcgagaccgaccaccacgccgtcagccgcgggtccgcgaagctgcggtggttcgtggagcgcaacctggtgacgcccgagggcaaggtcgtggacctcggctgcgggcggggcgggtggagctactactgcggcgggctgaagaacgtgcgcgaggtcaagggcctgaccaagggcgggcccggccacgaggagccgatccccatgtccacctacgggtggaacctcgtgcggctgcagagcggcgtggacgtcttcttcacgccgcccgagaagtgcgacacgctgctctgcgacatcggggagtccagcccgaaccccaccgtggaggccggccgcaccctgcgggtgctgaacctcgtcgagaactggctgaacaacaacacccagttctgcatcaaggtgctgaacccctacatgccgtccgtgatcgagaagatggaggccctgcagcgcaagtacggcggggccctcgtccggaaccccctgagccgcaacagcacccacgagatgtactgggtgtccaacgccagcggcaacatcgtgtccagcgtcaacatgatctcccggatgctgatcaaccgcttcacgatgcggcacaagaaggcgacctacgagcccgacgtggacctcgggagcggcacccgcaacatcgggatcgagtccgagacccccaacctggacatcatcggcaagcggatcgagaagatcaagcaggagcacgagacgagctggcactacgaccaggaccacccgtacaagacctgggcctaccacggctcctacgagaccaagcagaccgggagcgcctccagcatggtgaacggcgtcgtgcgcctgctcacgaagccctgggacgtgatccccatggtcacccagatggccatgaccgacaccacgcccttcgggcagcagcgcgtgttcaaggagaaggtggacacccggacccaggagccgaaggagggcaccaagaagctgatgaagatcacggccgagtggctgtggaaggagctcggcaagaagaagacgccccgcatgtgcacccgggaggagttcacccgcaaggtccggtccaacgcggccctgggggccatcttcacggacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggcgaagggcagccgcgccatctggtacatgtggctcggcgcccggttcctggagttcgaggccctggggttcctcaacgaggaccactggttctcccgcgagaacagcctgtccggcgtggagggggagggcctgcacaagctcgggtacatcctgcgggacgtcagcaagaaggagggcggcgcgatgtacgccgacgacaccgccgggtgggacacccgcatcacgctggaggacctcaagaacgaggagatggtgaccaaccacatggagggcgagcacaagaagctggccgaggccatcttcaagctgacctaccagaacaaggtggtccgggtgcagcgccccacgccccgggggacggtgatggacatcatcagccgccgggaccagcgcggctccgggcaggtcggcacctacggcctcaacaccttcaccaacatggaggcgcagctgatccggcagatggagggggagggcgtgttcaagagcatccagcacctgacggtgaccgaggagatcgccgtccagaactggctcgcccgcgtggggcgcgagcggctgtcccgcatggccatcagcggcgacgactgcgtggtcaagccgctggacgaccggttcgcctccgcgctcaccgccctgaacgacatgggcaaggtgcgcaaggacatccagcagtgggagcccagccgggggtggaacgactggacccaggtgcccttctgctcccaccacttccacgagctgatcatgaaggacggccgcgtcctcgtggtgccctgccggaaccaggacgagctgatcgggcgcgcccggatcagccagggcgccgggtggtccctgcgcgagacggcctgcctcggcaagagctacgcgcagatgtggtccctgatgtacttccaccggcgcgacctgcggctcgccgccaacgccatctgcagcgccgtcccgtcccactgggtgcccaccagccgcaccacctggtccatccacgcgcggcacgagtggatgaccacggaggacatgctgaccgtgtggaaccgcgtctgggtgcaggagaacccctggatggaggacaagacccccgtggagagctgggaggagatcccgtacctgggcaagcgggaggaccagtggtgcgggtccctcatcggcctgaccagccgcgccacgtgggccaagaacatccagaccgccatcaaccaggtccggagcctgatcgggaacgaggagtacaccgactacatgccctccatgaagcgcttccgccgggaggaggaggaggcgggcgtgctctggtga

SEQ ID NO: 9738 - RNA, 9876 nt, synthetic construct
  misc_feature 1..9876: note = derived and/or modified CDS sequence (opt1) from DENV-2__GQ398259__SS-prME
  source 1..9876: mol_type = other RNA
accgccggcatgatcatcatgctgatccccaccgtgatggccttccacctcaccacccgcaacggggagccccacatgatcgtgtcccggcaggagaagggcaagtccctgctgttcaagaccgaggacggggtgaacatgtgcaccctcatggcgatggacctgggcgagctgtgcgaggacaccatcacctacaactgccccctcctgcgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcccagcggatcgagacctggatcctgcgccaccccgggttcacgatcatggcggccatcctggcctacaccatcggcaccacctacttccagcgggtcctcatcttcatcctgctgacggccgtggcgccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggccaagctgaccaacacgaccaccgcgagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaaggtggtgcagcccgagaacctggagtacaccatcgtcatcacgccccactccggcgaggagaacgccgtggggaacgacacgggcaagcacgggaaggagatcaagatcaccccgcagagctccatcaccgaggccgagctgaccggctacgggaccgtgacgatggagtgcagcccccgcaccggcctcgacttcaacgagatggtcctgctgcagatggagaacaaggcctggctcgtgcaccggcagtggttcctggacctgcccctcccctggctgccgggcgcggacacccaggggtccaactggatccagaaggagaccctggtgacgttcaagaacccccacgccaagaagcaggacgtcgtggtcctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctggagaagcggcacgtgctcggccgcctgatcacggtcaacccgatcgtgaccgagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgccaagcggatggccatcctgggcgacacggcctgggacttcgggtccctgggcggggtgttcaccagcatcggcaaggcgctccaccaggtgttcggggccatctacggcgccgccttctccggcgtcagctggaccatgaagatcctgatcggggtggtgatcacctggatcggcatgaactcccgcagcacgtccctgagcgtctccctggtgctcgtgggggtcgtgaccctgtacctgggcgtgatggtccaggcggacagcgggtgcgtggtgtcctggaagaacaaggagctcaagtgcggcagcggcatcttcatcaccgacaacgtccacacctggacggagcagtacaagttccagcccgagagcccctccaagctggccagcgccatccagaaggcccacgaggaggggatctgcggcatccggtccgtgacccgcctggagaacctcatgtggaagcagatcacccccgagctgaaccacatcctgagcgagaacgaggtgaagctcaccatcatgacgggggacatcaagggcatcatgcaggccgggaagcggtccctgcgcccgcagcccaccgagctgaagtacagctggaagacctggggcaaggcgaagatgctctccaccgagctgcacaaccagacgttcctgatcgacggccccgagaccgccgagtgcccgaacaccaaccgggcctggaacagcctcgaggtcgaggactacgggttcggcgtgttcaccacgaacatctggctgaagctgaaggagcgccaggacgtgttctgcgactccaagctcatgagcgccgccatcaaggacaaccgggcggtccacgccgacatggggtactggatcgagtccgccctgaacgacacctggaagatcgagaaggccagcttcatcgaggtgaagtcctgccactggcccaagagccacaccctgtggtccaacggcgtgctcgagagcgagatgatcatccccaagaacttcgccggccccgtctcccagcacaactaccgcccggggtaccacacccagaccgcgggcccctggcacctggggaagctggagatggacttcgacttctgcgagggcacgaccgtggtggtcaccgaggactgcgggaaccggggccccagcctccgcaccacgaccgccagcggcaagctgatcaccgagtggtgctgccggtcctgcaccctgcccccgctccgctacaagggggaggacggctgctggtacgggatggagatccggcccctgaaggagaaggaggagaacctggtgaacagcctcgtgacggccggccacgggcagatcgacaacttctccctgggcgtcctgggcatggccctcttcctggaggagatgctgcgcacccgggtggggaccaagcacgcgatcctcctggtggccgtcagcttcgtgaccctgatcacgggcaacatgtccttccgcgacctcgggcgggtgatggtcatggtgggcgccaccatgaccgacgacatcgggatgggcgtgacctacctggccctgctcgccgcgttcaaggtccgccccacgttcgccgccggcctgctgctccgcaagctgaccagcaaggagctgatgatgaccaccatcgggatcgtgctcctgtcccagagcacgatccccgagaccatcctggagctcaccgacgccctggccctgggcatgatggtgctcaagatcgtcaagaacatggagaagtaccagctggcggtgaccatcatggccatcctgtgcgtcccgaacgccgtgatcctccagaacgcctggaaggtgtcctgcacgatcctggccgtcgtgagcgtgagccccctgctcctgaccagctcccagcagaaggcggactggatccccctggccctcaccatcaaggggctgaaccccaccgccatcttcctgacgaccctcagccggacctccaagaagcgcagctggccgctgaacgaggccatcatggcggtcggcatggtgtccatcctggccagctccctcctgaagaacgacatccccatgaccggccccctggtggccgggggcctcctgacggtctgctacgtgctgaccgggcggagcgccgacctcgagctggagcgcgccgcggacgtgcggtgggaggaccaggccgagatcagcggctccagccccatcctgtccatcaccatcagcgaggacgggtccatgagcatcaagaacgaggaggaggagcagaccctcacgatcctgatccgcaccggcctgctcgtcatctccggcctgttcccggtgagcatccccatcaccgccgccgcctggtacctgtgggaggtgaagaagcagcgggcgggggtcctctgggacgtgcccagcccgccgcccgtgggcaaggccgagctggaggacggggcctaccgcatcaagcagaagggcatcctggggtacagccagatcggcgccggcgtctacaaggaggggaccttccacaccatgtggcacgtgacgcggggcgccgtgctcatgcacaaggggaagcgcatcgagccctcctgggcggacgtcaagaaggacctgatcagctacggcgggggctggaagctggagggcgagtggaaggagggggaggaggtccaggtgctcgccctggagcccggcaagaacccccgggccgtccagaccaagcccgggctgttcaagaccaacaccggcacgatcggggccgtgtccctcgacttcagccccggcacctccggcagccccatcgtggacaagaaggggaaggtcgtgggcctgtacgggaacggcgtggtcacccgctccggcacctacgtgagcgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctcgcgccgacgcgggtcgtggccgccgagatggaggaggccctgcgcggcctgcccatccggtaccagacccccgccatccgcgcggagcacaccgggcgcgagatcgtggacctcatgtgccacgccaccttcacgatgcggctgctgagccccgtccgcgtgccgaactacaacctcatcatcatggacgaggcccacttcaccgaccccgccagcatcgccgcgcggggctacatctccacccgcgtggagatgggcgaggccgccgggatcttcatgaccgccacgccgcccggcagccgggacccgttcccccagtccaacgcccccatcatggacgaggagcgcgagatccccgagcggagctggaactccgggcacgagtgggtcaccgacttcaagggcaagaccgtgtggttcgtgccgagcatcaaggcggggaacgacatcgccgcctgcctgcgcaagaacggcaagaaggtcatccagctgtcccggaagaccttcgacagcgagtacatcaagacgcgcaccaacgactgggacttcgtggtgaccaccgacatctccgagatgggcgccaacttcaaggcggagcgggtcatcgacccccgccggtgcatgaagcccgtgatcctcacggacggggaggagcgcgtgatcctggccggccccatgccggtcacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgggagaaggtggacgccatcgacggcgagtaccgcctgcgcggggaggcccggaagaccttcgtggacctcatgcgccggggcgacctgcccgtctggctggcctaccgcgtggccgcggaggggatcaactacgccgaccggcgctggtgcttcgacggcatcaagaacaaccagatcctcgaggagaacgtcgaggtggagatctggacgaaggagggggagcggaagaagctgaagccgcgctggctggacgcccggatctactccgaccccctcgccctgaaggagttcaaggagttcgccgcgggccgcaagagcctgaccctcaacctgatcaccgagatgggccggctgcccaccttcatgacgcagaaggcccgcaacgccctcgacaacctggccgtgctgcacaccgcggaggccgggggccgggcctacaaccacgccctctccgagctgcccgagaccctggagaccctcctgctgctcacgctgctggccaccgtcaccgggggcatcttcctcttcctgatgagcggcaaggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacctacgtggtcatcgccatcctgaccgtggtggcggccaccatggccaacgagatgggcttcctggagaagacgaagaaggacttcgggctcggctccatcgccacccaccagccggagagcaacatcctggacatcgacctgcggcccgccagcgcgtggaccctctacgccgtcgccaccacgttcatcacccccatgctgcgccactccatcgagaacagctccgtgaacgtgagcctgaccgccatcgccaaccaggcgaccgtcctcatgggcctggggaagggctggcccctgtccaagatggacatcggggtgccgctcctggccatcggctgctacagccaggtgaaccccatcacgctgaccgccgccctcctgctgctcgtcgcgcactacgccatcatcgggcccggcctgcaggccaaggccacccgggaggcccagaagcgcgcggccgccggcatcatgaagaaccccaccgtggacgggatcacggtgatcgacctggacccgatcccctacgaccccaagttcgagaagcagctcggccaggtcatgctgctggtgctctgcgtgacccaggtcctgatgatgcggaccacctgggccctgtgcgaggccctcacgctggcgaccgggcccatctccaccctgtgggagggcaacccggggcgcttctggaacaccacgatcgccgtgagcatggccaacatcttccggggctcctacctcgccggcgccgggctgctgttcagcatcatgaagaacaccgcgaacacccgccgcggcaccgggaacacgggcgagaccctcggcgagaagtggaagaaccggctgaacgccctggggaagtccgagttccagatctacaagaagtccggcatccaggaggtggaccgcaccctcgccaaggaggggatcaagcggggcgagaccgaccaccacgccgtctcccgcgggagcgcgaagctgcggtggttcgtggagcgcaacctggtgacgcccgagggcaaggtcgtggacctcggctgcgggcggggcgggtggtcctactactgcggcgggctgaagaacgtgcgcgaggtcaagggcctgaccaagggcgggcccggccacgaggagcccatcccgatgagcacctacgggtggaacctcgtgcggctgcagtccggcgtggacgtcttcttcacgccgcccgagaagtgcgacacgctgctctgcgacatcggggagagctcccccaacccgaccgtggaggccggccgcaccctgcgggtgctgaacctcgtcgagaactggctgaacaacaacacccagttctgcatcaaggtgctgaacccctacatgcccagcgtgatcgagaagatggaggccctgcagcgcaagtacggcggggccctcgtccggaacccgctgagccgcaactccacccacgagatgtactgggtgagcaacgcctccggcaacatcgtgagctccgtcaacatgatcagccggatgctgatcaaccgcttcacgatgcggcacaagaaggcgacctacgagcccgacgtggacctcgggtccggcacccgcaacatcgggatcgagagcgagacccccaacctggacatcatcggcaagcggatcgagaagatcaagcaggagcacgagacgtcctggcactacgaccaggaccacccctacaagacctgggcctaccacggcagctacgagaccaagcagaccgggtccgccagctccatggtgaacggcgtcgtgcgcctgctcacgaagccgtgggacgtgatccccatggtcacccagatggccatgaccgacaccacgcccttcgggcagcagcgcgtgttcaaggagaaggtggacacccggacccaggagcccaaggagggcaccaagaagctgatgaagatcacggccgagtggctgtggaaggagctcggcaagaagaagaccccgcgcatgtgcacccgggaggagttcacccgcaaggtccggagcaacgcggccctgggggccatcttcacggacgagaacaagtggaagtccgcccgcgaggccgtggaggacagccggttctgggagctggtcgacaaggagcgcaacctccacctggagggcaagtgcgagacctgcgtgtacaacatgatggggaagcgggagaagaagctgggcgagttcgggaaggcgaagggctcccgcgccatctggtacatgtggctcggcgcccggttcctggagttcgaggccctggggttcctcaacgaggaccactggttcagccgcgagaactccctgagcggcgtggagggggagggcctgcacaagctcgggtacatcctgcgggacgtcagcaagaaggagggcggcgcgatgtacgccgacgacaccgccgggtgggacacccgcatcacgctggaggacctcaagaacgaggagatggtgaccaaccacatggagggcgagcacaagaagctggccgaggccatcttcaagctgacctaccagaacaaggtggtccgggtgcagcgccccacgccccgggggacggtgatggacatcatctcccgccgggaccagcgcggcagcgggcaggtcggcacctacggcctcaacaccttcaccaacatggaggcgcagctgatccggcagatggagggggagggcgtgttcaagtccatccagcacctgacggtgaccgaggagatcgccgtccagaactggctcgcccgcgtggggcgcgagcggctgagccgcatggccatctccggcgacgactgcgtggtcaagcccctggacgaccggttcgccagcgcgctcaccgccctgaacgacatgggcaaggtgcgcaaggacatccagcagtgggagccgtcccgggggtggaacgactggacccaggtgcccttctgcagccaccacttccacgagctgatcatgaaggacggccgcgtcctcgtggtgccctgccggaaccaggacgagctgatcgggcgcgcccggatctcccagggcgccgggtggagcctgcgcgagacggcctgcctcggcaagtcctacgcgcagatgtggagcctgatgtacttccaccggcgcgacctgcggctcgccgccaacgccatctgctccgccgtccccagccactgggtgccgacctcccgcaccacctggagcatccacgcgcggcacgagtggatgaccacggaggacatgctgaccgtgtggaaccgcgtctgggtgcaggagaacccctggatggaggacaagacccccgtggagtcctgggaggagatcccctacctgggcaagcgggaggaccagtggtgcgggagcctcatcggcctgaccagccgcgccacgtgggccaagaacatccagaccgccatcaaccaggtccggtccctgatcgggaacgaggagtacaccgactacatgccgagcatgaagcgcttccgccgggaggaggaggaggcgggcgtgctctggtga

SEQ ID NO: 9739 - RNA, 9876 nt, synthetic construct
  misc_feature 1..9876: note = derived and/or modified CDS sequence (opt1) from DENV-2__GQ398268__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcacctccacctgggtgacctacgggacctgcaccaccaccggcgagcaccggcgcgagaagcggagcgtcgccctggtgccccacgtgggcatggggctcgagacccgcaccgagacctggatgtccagcgagggcgcctggaagcacgcccagcggatcgagacctggatcctgcgccaccccgggttcaccatcatggccgcgatcctggcctacaccatcggcaccacgcacttccagcgggccctcatcttcatcctgctgaccgccgtcgcgccctccatgaccatgcgctgcatcgggatcagcaaccgggacttcgtggagggcgtgtccggcgggagctgggtcgacatcgtgctcgagcacggctcctgcgtgaccacgatggccaagaacaagcccaccctggacttcgagctgatcaagaccgaggccaagcagcccgccaccctccgcaagtactgcatcgaggccaagctgacgaacaccaccaccgagagccggtgcccgacgcagggggagccctccctgaacgaggagcaggacaagcgcttcgtctgcaagcacagcatggtggaccggggctggggcaacgggtgcggcctcttcgggaagggcgggatcgtgacctgcgcgatgttcacgtgcaagaagaacatggagggcaaggtcgtgcagcccgagaacctggagtacaccatcgtgatcacgccccactccggcgaggagcacgccgtcgggaacgacaccggcaagcacgggaaggagatcaagatcaccccgcagagctccatcaccgaggccgagctgaccggctacgggacggtgaccatggagtgcagcccccgcaccggcctcgacttcaacgagatggtgctgctgcagatggagaacaaggcctggctcgtccaccggcagtggttcctggacctgcccctcccctggctgccgggcgccgacacccaggggtccaactggatccagaaggagacgctggtgaccttcaagaacccccacgcgaagaagcaggacgtggtcgtgctcggcagccaggagggggccatgcacaccgccctgaccggcgccacggagatccagatgagctccgggaacctcctgttcaccggccacctgaagtgccgcctgcggatggacaagctccagctgaagggcatgagctactccatgtgcaccgggaagttcaaggtcgtgaaggagatcgccgagacccagcacggcacgatcgtgatccgcgtccagtacgagggggacggcagcccctgcaagatccccttcgagatcatggacctggagaagcggcacgtgctcggccgcctgatcaccgtgaacccgatcgtcaccgagaaggactcccccgtgaacatcgaggcggagccgcccttcggggacagctacatcatcatcggcgtggagccggggcagctgaagctcaactggttcaagaagggctccagcatcgggcagatgttcgagaccacgatgcgcggcgccaagcggatggccatcctgggcgacaccgcctgggacttcgggtccctgggcggggtcttcaccagcatcggcaaggccctccaccaggtgttcggggcgatctacggcgccgccttctccggcgtgagctggaccatgaagatcctgatcggggtcatcatcacgtggatcggcatgaactcccgcagcacctccctgagcgtgtccctggtgctcgtcggggtggtgaccctgtacctgggcgtcatggtgcaggccgacagcgggtgcgtggtctcctggaagaacaaggagctcaagtgcggcagcggcatcttcatcaccgacaacgtgcacacgtggaccgagcagtacaagttccagcccgagagcccctccaagctggcgagcgccatccagaaggcccacgaggaggggatctgcggcatccggtccgtgacccgcctggagaacctcatgtggaagcagatcacccccgagctgaaccacatcctgagcgagaacgaggtcaagctcacgatcatgaccggggacatcaagggcatcatgcaggccgggaagcggtccctgcgcccgcagcccaccgagctgaagtacagctggaagacctggggcaaggccaagatgctctccacggagagccacaaccagaccttcctgatcgacggccccgagaccgcggagtgcccgaacaccaaccgggcctggaactccctggaggtggaggactacgggttcggcgtgttcacgaccaacatctggctcaagctgcgcgagaagcaggacgtcttctgcgacagcaagctgatgtccgccgccatcaaggacaaccgggccgtgcacgcggacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagacggccggcccctggcacctcgggaagctggagatggacttcgacttctgcgagggcaccaccgtggtcgtgaccgaggactgcgggaaccggggccccagcctgcgcacgaccaccgcgtccggcaagctcatcaccgagtggtgctgccggagctgcacgctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggccctgttcctcgaggagatgctgcggacccgcgtggggaccaagcacgccatcctgctcgtcgcggtgtccttcgtgacgctgatcaccggcaacatgagcttccgggacctggggcgcgtcatggtgatggtgggcgccaccatgaccgacgacatcgggatgggcgtcacgtacctcgccctgctggccgccttcaaggtgcgccccaccttcgcggccggcctcctgctgcggaagctcacctccaaggagctgatgatgaccacgatcgggatcgtgctgctcagccagtccaccatccccgagaccatcctggagctgaccgacgccctcgccctgggcatgatggtcctgaagatggtgcgcaagatggagaagtaccagctcgccgtgacgatcatggcgatcctgtgcgtcccgaacgccgtgatcctgcagaacgcctggaaggtcagctgcaccatcctcgccgtggtgtccgtcagccccctgctgctcacctccagccagcagaaggccgactggatccccctggcgctgaccatcaaggggctcaaccccacggccatcttcctgaccaccctgtcccggaccaacaagaagcgcagctggccgctcaacgaggccatcatggccgtgggcatggtgtccatcctggcgagctccctgctcaagaacgacatccccatgacgggccccctggtcgccgggggcctgctcaccgtgtgctacgtgctgaccgggcggagcgccgacctggagctcgagcgcgccgccgacgtcaagtgggaggaccaggcggagatcagcggctccagccccatcctgtccatcaccatcagcgaggacgggtccatgagcatcaagaacgaggaggaggagcagacgctgaccatcctcatccggaccggcctgctggtgatctccggcctcttcccggtgagcatccccatcaccgccgccgcctggtacctgtgggaggtcaagaagcagcgcgccggggtgctgtgggacgtgcccagcccgccgcccgtcggcaaggcggagctcgaggacggggcctaccggatcaagcagaagggcatcctggggtacagccagatcggcgccggcgtgtacaaggaggggaccttccacacgatgtggcacgtgacccgcggcgccgtcctgatgcacaaggggaagcggatcgagccctcctgggccgacgtgaagaaggacctcatcagctacggcgggggctggaagctggagggcgagtggaaggagggggaggaggtgcaggtcctggcgctcgagcccggcaagaacccccgcgccgtgcagaccaagcccgggctgttcaagaccaacgccggcacgatcggggccgtgtccctggacttcagccccggcacctccggcagccccatcatcgacaagaaggggaaggtcgtgggcctctacgggaacggcgtggtcacccggtccggcgcctacgtgagcgcgatcgcccagaccgagaagtccatcgaggacaaccccgagatcgaggacgacatcttccgcaagcggaagctgacgatcatggacctgcaccccggggccggcaagaccaagcgctacctgcccgccatcgtgcgggaggcgatcaagcgcgggctccggaccctgatcctggccccgacccgcgtcgtggccgccgagatggaggaggccctccggggcctgcccatccgctaccagacgcccgcgatccgcgccgagcacaccgggcgggagatcgtggacctgatgtgccacgccaccttcaccatgcgcctcctgagccccgtccgggtgccgaactacaacctgatcatcatggacgaggcccacttcacggaccccgccagcatcgcggcccgcggctacatctccacccgggtggagatgggcgaggccgccgggatcttcatgaccgccacgccgcccggcagccgcgacccgttcccccagtccaacgcgcccatcatggacgaggagcgggagatccccgagcgcagctggtccagcgggcacgagtgggtcacggacttcaagggcaagaccgtgtggttcgtgccgtccatcaaggccgggaacgacatcgccgcctgcctccggaagaacggcaagaaggtcatccagctgagccgcaagaccttcgactccgagtacgtgaagacccggacgaacgactgggacttcgtggtcaccaccgacatcagcgagatgggcgcgaacttcaaggccgagcgcgtgatcgacccccggcgctgcatgaagcccgtgatcctgaccgacggggaggagcgggtcatcctcgccggccccatgccggtgacgcactccagcgccgcccagcgccgggggcgcatcggccggaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccgcctgcgcggggaggcccgcaagaccttcgtcgacctgatgcggcgcggcgacctccccgtgtggctggcctaccgggtggcggccgaggggatcaactacgccgaccgccggtggtgcttcgacggcatcaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgacgctgaacctcatcaccgagatgggccgcctgcccaccttcatgacccagaaggcccgggacgccctggacaacctcgcggtcctgcacacggccgaggccgggggccgcgcctacaaccacgccctgagcgagctccccgagaccctggagaccctgctcctgctgaccctcctggcgacggtgaccgggggcatcttcctgttcctcatgtccggccgggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacctggggctcggcagcatcacgacccagcagccggagagcaacatcctggacatcgacctgcggcccgcctccgcgtggaccctctacgccgtggccaccacgttcgtgacccccatgctgcgccacagcatcgagaactccagcgtcaacgtgtccctgaccgccatcgccaaccaggcgaccgtgctcatgggcctggggaagggctggcccctgagcaagatggacatcggggtcccgctcctggccatcggctgctactcccaggtgaaccccatcacgctgaccgccgccctcctgctgctcgtggcgcactacgccatcatcgggcccggcctgcaggccaaggccacccgggaggcccagaagcgcgcggccgccggcatcatgaagaaccccaccgtcgacgggatcacggtgatcgacctggacccgatcccctacgaccccaagttcgagaagcagctcggccaggtgatgctgctggtcctctgcgtgacccaggtgctgatgatgcggaccacctgggccctgtgcgaggccctcacgctggcgaccgggcccatcagcaccctgtgggagggcaacccggggcgcttctggaacaccacgatcgccgtctccatggccaacatcttccgcggcagctacctcgccggcgccgggctgctgttctccatcatgaagaacaccaccaacacccggcgcggcacggggaacatcggcgagaccctcggcgagaagtggaagtcccggctgaacgcgctggggaagtccgagttccagatctacaagaagtccggcatccaggaggtggaccgcaccctcgccaaggaggggatcaagcggggcgagaccgaccaccacgccgtgtcccgcgggagcgccaagctgcggtggttcgtcgagcgcaacatggtgacgcccgagggcaaggtggtcgacctgggctgcgggcggggcgggtggtcctactactgcggcgggctcaagaacgtgcgcgaggtgaagggcctgaccaagggcgggcccggccacgaggagcccatcccgatgagcacctacgggtggaacctggtccggctccagtccggcgtggacgtgttcttcacgccgcccgagaagtgcgacacgctgctgtgcgacatcggggagagcagccccaacccgaccgtcgaggcgggccgcaccctccgggtgctgaacctggtggagaactggctcaacaacaacacccagttctgcatcaaggtcctgaacccctacatgccctccgtgatcgagaagatggaggccctgcagcgcaagtacggcggggccctggtgcggaacccgctcagccgcaactccacccacgagatgtactgggtcagcaacgcctccggcaacatcgtgagctccgtgaacatgatcagccggatgctgatcaaccgcttcacgatgcggcacaagaaggccacctacgagcccgacgtcgacctggggtccggcacccgcaacatcgggatcgagagcgagatccccaacctcgacatcatcggcaagcgcatcgagaagatcaagcaggagcacgagacctcctggcactacgaccaggaccacccctacaagacgtgggcgtaccacggcagctacgagaccaagcagaccgggtccgccagctccatggtgaacggcgtggtccggctgctgaccaagccgtgggacgtggtgcccatggtcacgcagatggccatgaccgacaccacccccttcgggcagcagcgcgtgttcaaggagaaggtggacacgcggacccaggagcccaaggagggcaccaagaagctcatgaagatcaccgccgagtggctgtggaaggagctgggcaagaagaagacgccgcgcatgtgcacccgggaggagttcacccgcaaggtccggagcaacgccgcgctcggggccatcttcaccgacgagaacaagtggaagtccgcccgcgaggccgtggaggacagccggttctgggagctggtcgacaaggagcgcaacctgcacctcgagggcaagtgcgagacgtgcgtgtacaacatgatggggaagcgggagaagaagctgggcgagttcgggaaggccaagggctcccgcgcgatctggtacatgtggctgggcgcccggttcctcgagttcgaggccctggggttcctgaacgaggaccactggttcagccgcgagaacagcctctccggcgtggagggggagggcctgcacaagctggggtacatcctccgggacgtcagcaagaaggagggcggcgccatgtacgcggacgacaccgccgggtgggacacccgcatcaccctggaggacctgaagaacgaggagatggtgacgaaccacatggagggcgagcacaagaagctcgccgaggccatcttcaagctgacctaccagaacaaggtggtccgggtgcagcgccccacgccccgggggaccgtgatggacatcatctcccgccgggaccagcgcggcagcgggcaggtcggcacgtacggcctgaacaccttcaccaacatggaggcccagctcatccgccagatggagggggagggcgtgttcaagtccatccagcacctgaccgtgacggaggagatcgcggtccagaactggctggcccgggtggggcgcgagcggctcagccgcatggccatctccggcgacgactgcgtggtcaagcccctggacgaccggttcgccagcgccctgaccgcgctcaacgacatgggcaaggtgcgcaaggacatccagcagtgggagccgtcccgggggtggaacgactggacccaggtgcccttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtccccagccactgggtgccgacgtcccgcaccacctggagcatccacgccaagcacgagtggatgaccaccgaggacatgctcacggtgtggaaccgggtctggatccaggagaacccctggatggaggacaagacccccgtggagagctgggaggagatcccctacctgggcaagcgcgaggaccagtggtgcgggtccctgatcggcctcaccagccgggcgacctgggccaagaacatccagacggccatcaaccaggtgcgctccctgatcgggaacgaggagtacaccgactacatgccgagcatgaagcgcttccggcgcgaggaggaggaggccggcgtcctgtggtga

SEQ ID NO: 9740 - RNA, 9876 nt, synthetic construct
  misc_feature 1..9876: note = derived and/or modified CDS sequence (opt1) from DENV-2__GQ398263__SS-prME
  source 1..9876: mol_type = other RNA
accgccgggatgatcatcatgatgatccccaccgtgatggccttccacctgaccacccggaacggggagccccacatgatcgtcagccggcaggagaagggcaagagcctcctgttcaagaccgaggacggggtgaacatgtgcaccctgatggcgatggacctcggggagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaagatcaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtggtgcgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgtccgagaacgaggtgaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaccaccaaccgggcctggaactccctggaggtggaggactacgggttcggcgtcttcacgaccaacatctggctcaagctgaaggagcgccaggacgtgctgtgcgacagcaagctcatgtccgccgccatcaaggacaaccgggcggtgcacgccgacatggggtactggatcgagagcgccctgaacgacacctggaagatcgagaaggcctccttcatcgaggtcaagagctgccactggcccaagtcccacaccctgtggagcaacggcgtgctcgagtccgagatgatcatccccaagaacttcgccggccccgtgagccagcacaactaccgcccggggtaccacacccagacggcgggcccctggcacctggggaagctggagatggacttcgacttctgcgagggcaccaccgtcgtggtgaccgaggactgcgggaaccggggccccagcctccgcacgaccaccgcctccggcaagctgatcaccgagtggtgctgccggagctgcacgctgcccccgctccgctaccgcggggaggacggctgctggtacgggatggagatccgccccctgaaggacaaggaggagaacctggtcaactccctcgtgaccgccggccacgggcagatcgacaacttcagcctgggcgtgctgggcatggccctcttcctggaggagatgctgcggacccgcgtcgggaccaagcacgcgatcctcctggtggccgtgtccttcgtcacgctgatcaccggcaacatgagcttccgggacctcgggcgcgtgatggtgatggtcggcgccaccatgaccgacgacatcgggatgggcgtgacgtacctggccctgctcgccgcgttcaaggtgcgccccaccttcgccgccggcctgctgctccggaagctgacctccaaggagctgatgatgaccacgatcgggatcgtcctcctgagccagtccaccatccccgagaccatcctggagctcaccgacgccctggccctgggcatgatggtgctcaagatcgtccgcaacatggagaagtaccagctggcggtgacgatcatggccatcctgtgcgtgccgaacgccgtcatcctccagaacgcctggaaggtgagctgcaccatcctggccgtggtctccgtgagccccctgctcctgacctccagccagcagaaggcggactggatccccctggccctcaccatcaaggggctgaaccccacggccatcttcctgaccaccctctcccggaccagcaagaagcgctcctggccgctgaacgaggccatcatggcggtgggcatggtcagcatcctggcctccagcctcctgaagaacgacatccccatgacgggccccctggtggccgggggcctcctgaccgtgtgctacgtcctgaccgggcggagcgccgacctcgagctggagcgcgccgcggacgtgcggtgggaggaccaggccgagatctccggcagctcccccatcctgagcatcaccatctccgaggacgggagcatgtccatcaagaacgaggaggaggagcagacgctcaccatcctgatccgcaccggcctgctcgtgatcagcggcctgttcccggtctccatccccatcaccgccgccgcctggtacctgtgggaggtgaagaagcagcgggcgggggtgctctgggacgtccccagcccgccgcccgtgggcaaggccgagctggaggacggggcctaccgcatcaagcagaagggcatcctggggtactcccagatcggcgccggcgtgtacaaggaggggaccttccacacgatgtggcacgtcacccggggcgccgtgctcatgcacaaggggaagcgcatcgagcccagctgggcggacgtgcggaaggacctgatctcctacggcgggggctggaagctggagggcgagtggaaggagggggaggaggtccaggtgctcgccctggagcccggcaagaacccccgcgccgtgcagaccaagcccgggctgttcaagaccaacacgggcaccatcggggccgtcagcctcgacttctcccccggcaccagcggctcccccatcgtggacaagaaggggaaggtggtcggcctgtacgggaacggcgtggtgacccggagcggcacgtacgtctccgccatcgcgcagaccgagaagtccatcgaggacaaccccgagatcgaggacgacatcttccgcaagaagcggctgaccatcatggacctgcaccccggggccggcaagaccaagcgctacctccccgccatcgtgcgggaggccatcaagcgcgggctgcggacgctgatcctcgcgccgacccgcgtggtcgccgccgagatggaggaggccctgcgcggcctgcccatccggtaccagacccccgccatccgcgcggagcacaccgggcgggagatcgtggacctcatgtgccacgccacgttcaccatgcgcctgctgagccccgtgcgggtcccgaactacaacctcatcatcatggacgaggcccacttcaccgaccccgcctccatcgccgcgcgcggctacatcagcacccgggtggagatgggcgaggccgccgggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggcggggaacgacatcgccgcctgcctgcggaagaacggcaagaaggtgatccagctgagccgcaagacgttcgactccgagtacatcaagacccggaccaacgactgggacttcgtcgtgaccacggacatcagcgagatgggcgccaacttcaaggcggagcgcgtgatcgacccccggcgctgcatgaagcccgtcatcctcaccgacggggaggagcgggtgatcctggccggccccatgccggtgacccactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtcgacgccatcgacggcgagtaccgcctgcgcggggaggcccgcaagacgttcgtggacctcatgcggcgcggcgacctgcccgtctggctggcctaccgggtggccgcggaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccacgttcatgacccagaaggcccggaacgccctcgacaacctggccgtgctgcacaccgcggaggccgggggccgcgcctacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggcgagcatcctcctgtggtacgcccagatccagccgcactggatcgccgcctccatcatcctggagttcttcctcatcgtcctgctgatccccgagcccgagaagcagcggacgccccaggacaaccagctcacctacgtggtgatcgccatcctgaccgtcgtggcggccacgatggccaacgagatgggcttcctggagaagaccaagaaggacttcgggctcggcagcatcgccacccagcagccggagagcaacatcctggacatcgacctgcgccccgcctccgcgtggaccctctacgccgtggccacgaccttcatcacccccatgctgcggcacagcatcgagaactccagcgtcaacgtgtccctgaccgccatcgccaaccaggcgacggtgctcatgggcctggggaagggctggcccctgagcaagatggacatcggggtcccgctcctggccatcggctgctactcccaggtgaaccccatcaccctgaccgccgccctcctgctgctcgtggcgcactacgccatcatcgggcccggcctgcaggccaaggccacccgcgaggcccagaagcgggcggccgccggcatcatgaagaaccccacggtcgacgggatcaccgtgatcgacctggacccgatcccctacgaccccaagttcgagaagcagctcggccaggtgatgctgctggtcctctgcgtgacccaggtgctgatgatgcgcaccacgtgggccctgtgcgaggccctcaccctggcgaccgggcccatcagcaccctgtgggagggcaacccggggcgcttctggaacacgaccatcgccgtctccatggccaacatcttccggggcagctacctcgccggcgccgggctgctgttctccatcatgaagaacaccgcgaacacccgccggggcacggggaacaccggcgagaccctcggcgagaagtggaagaaccgcctgaacgccctgggcaagagcgagttccagatctacaagaagtccggcatccaggaggtggaccggaccctcgccaaggaggggatcaagcgcggcgagacggaccaccacgccgtgagccgggggtccgcgaagctgcgctggttcgtcgagcggaacctggtgacccccgagggcaaggtggtcgacctcggctgcgggcgcggcgggtggagctactactgcggcgggctgaagaacgtgaaggaggtgaagggcctgaccaagggcgggcccggccacgaggagcccatcccgatgtccacctacgggtggaacctcgtccggctgcagagcggcgtggacgtgttcttcacgccgcccgagaagtgcgacaccctgctctgcgacatcggggagtccagccccaacccgaccgtcgaggccggccgcaccctgcgggtgctgaacctcgtggagaactggctgaacaacaacacccagttctgcatcaaggtcctgaacccctacatgcccagcgtgatcgagaagatggaggccctgcagcgcaagtacggcggggccctcgtgcggaacccgctgtcccgcaacagcacgcacgagatgtactgggtctccaacgccagcggcaacatcgtgtccagcgtgaacatgatctcccggatgctgatcaaccgcttcaccatgcggcacaagaaggcgacctacgagcccgacgtcgacctcgggagcggcacccgcaacatcgggatcgagtccgagatccccaacctggacgtgatcggcaagcgcatcgagaagatcaagcaggagcacgagacgagctggcactacgaccaggaccacccctacaagacctgggcctaccacggctcctacgagaccaagcagaccgggagcgcctccagcatggtgaacggcgtcgtgcggctgctcacgaagccgtgggacgtgatccccatggtcacccagatggccatgaccgacaccacgcccttcgggcagcagcgcgtgttcaaggagaaggtcgacacccggacccaggagcccaaggagggcaccaagaagctgatgaagatcacggccgagtggctgtggaaggagctcggcaagaagaagaccccgcgcatgtgcacccgggaggagttcacccgcaaggtgcggtccaacgcggccctgggggccatctacacggacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggcgaagggcagccgcgccatctggtacatgtggctcggcgcccggttcctggagttcgaggccctggggttcctcaacgaggaccactggttctcccgcgagaacagcctgagcggcgtggagggggagggcctgcacaagctcgggtacatcctgcgggacgtctccaagaaggagggcggcgcgatgtacgccgacgacaccgccgggtgggacacccgcatcacgctggaggacctcaagaacgaggagatggtgaccaaccacatggagggcgagcacaagaagctggccgaggccatcttcaagctgacctaccagaacaaggtggtccgggtgcagcgccccacgccccgggggacggtgatggacatcatcagccgccgggaccagcgcggctccgggcaggtcgtgacctacggcctcaacaccttcaccaacatggaggcgcagctgatccgccagatggagggcgagggggtgttcaagagcatccagcacctgacggtcaccgaggagatcgccgtgaagaactggctcgcccgggtgggccgcgagcggctgtcccgcatggccatcagcggggacgactgcgtcgtgaagcccctggacgaccggttcgcctccgcgctcaccgccctgaacgacatgggcaaggtgcgcaaggacatccagcagtgggagccgagccggggctggaacgactggacccaggtccccttctgctcccaccacttccacgagctgatcatgaaggacgggcgcgtgctcgtggtcccctgccggaaccaggacgagctgatcggccgcgcccggatcagccagggggccggctggtccctgcgcgagacggcctgcctcggcaagagctacgcgcagatgtggtccctgatgtacttccaccggcgcgacctgcggctcgccgccaacgccatctgcagcgccgtgccctcccactgggtgccgaccagccgcaccacctggtccatccacgcgacccacgagtggatgacgaccgaggacatgctgaccgtctggaaccgggtgtggatccaggagaacccctggatggaggacaagacccccgtggagagctgggaggagatcccctacctgggcaagcgcgaggaccagtggtgcggcagcctcatcgggctgacgtcccgggccacctgggccaagaacatccagaccgccatcaaccaggtccgcagcctgatcggcaacgaggagtacaccgactacatgccgtccatgaagcgcttccggcgcgaggaggaggaggcgggggtgctctggtga

SEQ ID NO: 9741 - RNA, 9876 nt, synthetic construct
  misc_feature 1..9876: note = derived and/or modified CDS sequence (opt1) from DENV-2__GQ398264__SS-prME
  source 1..9876: mol_type = other RNA
accgccgggatgatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgaccgccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaagatcaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgccatcaaggacaaccgggcggtgcacgccgacatggggtactggatcgagagcgccctcaacgacacctggatgatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgcgggcccctggcagctcgggaagctggagatggacttcgacttctgcgagggcacgaccgtggtcgtgaccgaggactgcgggaaccggggccccagcctgcgcaccacgaccgcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcacggccggccacgggcagatcgacaacttcagcctcggcgtgctgggcatggccctgttcctcgaggagatgctgcggacccgcgtggggaccaagcacgcgatcctgctcgtcgccgtgtccttcgtgaccctgatcacgggcaacatgagcttccgggacctggggcgcgtcatggtgatggtgggcgccaccatgaccgacgacatcgggatgggcgtcacctacctcgccctgctggccgcgttcaaggtgcgccccacgttcgccgccggcctcctgctgcggaagctcacctccaaggagctgatgatgaccaccatcgggatcgtgctgctcagccagtccacgatccccgagaccatcctggagctgaccgacgccctcgccctgggcatgatggtcctgaagatcgtgcgcaacatggagaagtaccagctcgcggtcaccatcatggccatcctgtgcgtgccgaacgccgtgatcctgcagaacgcctggaaggtcagctgcacgaccctcgccgtggtgtccgtcagccccctgctgctcacctccagccagcagaaggcggactggatccccctggccctgaccatcaaggggctcaaccccacggccatcttcctgaccaccctgtcccggaccagcaagaagcgctcctggccgctcaacgaggccatcatggcggtgggcatggtgagcatcctggcctccagcctgctcaagaacgacatccccatgacgggccccctggtcgccgggggcctgctcaccgtgtgctacgtgctgaccgggcggagcgccgacctggagctcgagcgcgccgcggacgtccggtgggaggaccaggccgagatctccggcagctcccccatcctgagcatcaccatctccgaggacgggagcatgtccatcaagaacgaggaggaggagcagacgctgaccatcctcatccgcaccggcctgctggtgatcagcggcctcttcccggtgtccatccccatcaccgccgccgcctggtacctgtgggaggtcaagaagcagcgggcgggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacacgatgtggcacgtgacccggggcgccgtcctgatgcacaaggggaagcgcatcgagcccagctgggcggacgtgcggaaggacctcatctcctacggcgggggctggaagctggagggcgagtggaaggagggggaggaggtgcaggtcctggccctcgagcccggcaagaacccccgcgccgtgcagaccaagcccgggctgttcaagaccaacacgggcaccatcggggccgtgagcctggacttctcccccggcaccagcggctcccccatcgtcgacaagaaggggaaggtggtgggcctctacgggaacggcgtcgtgacccggagcggcacgtacgtgtccgccatcgcgcagaccgagaagtccatcgaggacaaccccgagatcgaggacgacatcttccgcaagaagcggctgaccatcatggacctgcaccccggggccggcaagaccaagcgctacctgcccgccatcgtccgggaggccatcaagcgcgggctccggacgctgatcctggcgccgacccgcgtggtggccgccgagatggaggaggccctccgcggcctgcccatccggtaccagacccccgccatccgcgcggagcacaccgggcgggagatcgtcgacctgatgtgccacgccacgttcaccatgcgcctcctgagccccgtgcgggtgccgaactacaacctgatcatcatggacgaggcccacttcaccgaccccgcctccatcgccgcgcgcggctacatcagcacccgggtcgagatgggcgaggccgccgggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctccggaagaacggcaagaaggtgatccagctgagccgcaagacgttcgactccgagtacatcaagacccggaccaacgactgggacttcgtggtcaccacggacatcagcgagatgggcgccaacttcaaggcggagcgcgtgatcgacccccggcgctgcatgaagcccgtgatcctgaccgacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcccactggaaggaggcgaagatgctgctcgacaacatcaacacccccgagggcatcatcccgtccatgttcgagcccgagcgggagaaggtcgacgccatcgacggcgagtaccgcctgcgcggggaggcccgcaagacgttcgtggacctgatgcggcgcggcgacctccccgtctggctggcctaccgggtggccgcggaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccacgttcatgacccagaaggcccggaacgccctggacaacctcgccgtgctgcacaccgcggaggccgggggccgcgcctacaaccacgccctgagcgagctccccgagaccctggagacgctgctcctgctgaccctcctggccaccgtcaccgggggcatcttcctgttcctcatgtccggcaaggggatcggcaagatgaccctggggatgtgctgcatcatcacggcgagcatcctgctctggtacgcccagatccagccgcactggatcgccgcctccatcatcctggagttcttcctgatcgtgctcctgatccccgagcccgagaagcagcggacgccccaggacaaccagctgacctacgtggtcatcgccatcctcaccgtggtggcggccacgatggccaacgagatgggcttcctggagaagaccaagaaggacttcgggctgggcagcaccgccacccagcagccggagagcaacatcctcgacatcgacctgcgccccgcctccgcgtggacgctgtacgccgtcgccaccaccttcatcacccccatgctccggcacagcatcgagaactccagcgtgaacgtgtccctgacggccatcgccaaccaggcgaccgtcctgatgggcctcgggaagggctggcccctgagcaagatggacatcggggtgccgctgctcgccatcggctgctactcccaggtgaaccccatcaccctgaccgccgccctgctcctgctggtcgcgcactacgccatcatcgggcccggcctccaggccaaggccacgcgcgaggcccagaagcgggcggccgccggcatcatgaagaaccccaccgtggacgggatcaccgtgatcgacctggacccgatcccctacgaccccaagttcgagaagcagctgggccaggtcatgctcctggtgctgtgcgtgacccaggtcctcatgatgcgcacgacctgggccctgtgcgaggccctgaccctcgcgaccgggcccatcagcacgctgtgggagggcaacccggggcgcttctggaacaccaccatcgccgtgtccatggccaacatcttccggggcagctacctggccggcgccgggctcctgttctccatcatgaagaacaccgcgaacacgcgccggggcaccgggaacaccggcgagaccctgggcgagaagtggaagaaccgcctcaacgccctgggcaagagcgagttccagatctacaagaagtccggcatccaggaggtggaccggacgctggccaaggaggggatcaagcgcggcgagaccgaccaccacgccgtcagccgggggtccgcgaagctccgctggttcgtggagcggaacctggtgacccccgagggcaaggtcgtggacctgggctgcgggcgcggcgggtggagctactactgcggcgggctcaagaacgtgaaggaggtcaagggcctgaccaagggcgggcccggccacgaggagcccatcccgatgtccacgtacgggtggaacctggtgcggctccagagcggcgtggacgtcttcttcacgccgcccgagaagtgcgacaccctgctgtgcgacatcggggagtccagccccaacccgaccgtggaggccggccgcaccctccgggtgctgaacctggtcgagaactggctcaacaacaacacgcagttctgcatcaaggtgctgaacccctacatgcccagcgtgatcgagaagatggaggccctgcagcgcaagtacggcggggccctggtccggaacccgctctcccgcaacagcacccacgagatgtactgggtgtccaacgccagcggcaacatcgtgtccagcgtcaacatgatctcccggatgctgatcaaccgcttcaccatgcggcacaagaaggcgacctacgagcccgacgtggacctggggagcggcacgcgcaacatcgggatcgagtccgagacccccaacctcgacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcggctgctgaccaagccgtgggacgtgatccccatggtcacccagatggccatgacggacaccacccccttcgggcagcagcgcgtgttcaaggagaaggtcgacacccggacgcaggagcccaaggagggcaccaagaagctcatgaagatcaccgccgagtggctgtggaaggagctgggcaagaagaagaccccgcgcatgtgcacgcgggaggagttcacccgcaaggtgcggtccaacgcggccctcggggccatcttcaccgacgagaacaagtggaagtccgcccgcgaggccgtggaggactccggcttctgggagctggtcgacaaggagcggaacctgcacctcgaggggaagtgcgagacctgcgtgtacaacatgatgggcaagcgcgagaagaagctgggggagttcggcaaggcgaagggcagccgggccatctggtacatgtggctgggggcccgcttcctcgagttcgaggccctgggcttcctgaacgaggaccactggttctcccgggagaacagcctcagcggggtggagggcgaggggctgcacaagctgggctacatcctccgcgacgtctccaagaaggagggcggggcgatgtacgccgacgacacggccggctgggacacccggatcaccctggaggacctgaagaacgaggagatggtgaccaaccacatggagggggagcacaagaagctcgccgaggccatcttcaagctgacgtaccagaacaaggtggtccgcgtgcagcggcccacgccccggggcaccgtgatggacatcatcagccggcgcgaccagcgggggtccggccaggtcgtgacctacggcctgaacacgttcaccaacatggaggcgcagctcatccgccagatggagggggagggcgtgttcaagagcatccagcacctgaccgtcaccgaggagatcgccgtgaagaactggctggcccgcgtggggcgggagcgcctctcccggatggccatcagcggcgacgactgcgtcgtgaagcccctggacgaccgcttcgcctccgcgctgacggccctcaacgacatgggcaaggtgcggaaggacatccagcagtgggagccgagccgcgggtggaacgactggacccaggtccccttctgctcccaccacttccacgagctgatcatgaaggacggccgggtgctggtggtcccctgccgcaaccaggacgagctcatcgggcgggcccgcatcagccagggcgccgggtggtccctgcgggagaccgcctgcctgggcaagagctacgcgcagatgtggtccctcatgtacttccaccgccgggacctgcgcctggccgccaacgccatctgcagcgccgtgccctcccactgggtgccgaccagccggaccacgtggtccatccacgcgacccacgagtggatgaccaccgaggacatgctcacggtctggaaccgcgtgtggatccaggagaacccctggatggaggacaagacccccgtggagagctgggaggagatcccctacctgggcaagcgggaggaccagtggtgcgggagcctgatcggcctcacctcccgcgccacctgggccaagaacatccagacggccatcaaccaggtccggagcctgatcgggaacgaggagtacaccgactacatgccgtccatgaagcgcttccgccgggaggaggaggaggcgggcgtgctgtggtga

SEQ ID NO: 9742 - RNA, 9876 nt, synthetic construct
  misc_feature 1..9876: note = derived and/or modified CDS sequence (opt1) from DENV-2__GQ398260__SS-prME
  source 1..9876: mol_type = other RNA
accgccggcatgatcatcatgctgatccccaccgtgatggccttccacctcaccacccggaacggggagccccacatgatcgtctcccggcaggagaagggcaagtccctgctgttcaagaccgaggacggggtgaacatgtgcaccctcatggcgatggacctgggcgagctgtgcgaggacaccatcacctacaactgccccctcctgcgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcccagcggatcgagacctggatcctgcgccaccccgggttcaccatcatggcggccatcctggcctacaccatcggcaccacctacttccagcgggtcctcatcttcatcctgctgacggccgtggcgccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggccaagctgaccaacacgaccaccgcgagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaaggtggtgcagcccgagaacctggagtacaccatcgtcatcacgccccactccggcgaggagaacgccgtggggaacgacacgggcaagcacgggaaggagatcaagatcaccccgcagagctccatcaccgaggccgagctgatcggctacgggaccgtgaccatggagtgcagcccccgcacgggcctcgacttcaacgagatggtcctgctgcagatggagaacaaggcctggctcgtgcaccggcagtggttcctggacctgcccctcccctggctgccgggcgcggacacccaggggtccaactggatccagaaggagaccctggtgaccttcaagaacccccacgccaagaagcaggacgtcgtggtcctcggcagccaggagggggccatgcacacggccctgaccggcgccaccgagatccagatgagctccgggaacctcctgttcaccggccacctgaagtgccgcctgcggatggacaagctccagctgaagggcatgagctactccatgtgcacggggaagttcaaggtggtgaaggagatcgcggagacccagcacggcaccatcgtcatccgcgtgcagtacgagggggacggcagcccctgcaagatccccttcgagatcatggacctggagaagcggcacgtgctcggccgcctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgccaagcggatggccatcctgggcgacaccgcctgggacttcgggtccctgggcggggtgttcacgagcatcggcaaggcgctccaccaggtgttcggggccatctacggcgccgccttctccggcgtcagctggaccatgaagatcctgatcggggtggtgatcacctggatcggcatgaactcccgcagcacctccctgagcgtctccctggtgctcgtgggggtcgtgacgctgtacctgggcgtgatggtccaggcggacagcgggtgcgtggtgtcctggaagaacaaggagctcaagtgcggcagcggcatcttcgtcaccgacaacgtgcacacctggaccgagcagtacaagttccagcccgagagcccctccaagctggccagcgccatccagaaggcccacgaggaggggatctgcggcatccggtccgtgacgcgcctggagaacctcatgtggaagcagatcacccccgagctgaaccacatcctgagcgagaacgaggtcaagctcaccatcatgaccggggacatcaagggcatcatgcaggccgggaagcggtccctgcgcccgcagcccacggagctgaagtacagctggaagacctggggcaaggcgaagatgctctccaccgagctgcacaaccagaccttcctgatcgacggccccgagacggccgagtgcccgaacaccaaccgggcctggaacagcctcgaggtggaggactacgggttcggcgtgttcaccaccaacatctggctgaagctgaaggagcgccaggacgtcttctgcgactccaagctcatgagcgccgccatcaaggacaaccgggcggtgcacgccgacatggggtactggatcgagtccgccctgaacgacacgtggaagatcgagaaggccagcttcatcgaggtgaagtcctgccactggcccaagagccacaccctgtggtccaacggcgtcctcgagagcgagatgatcatccccaagaacttcgccggccccgtgtcccagcacaactaccgcccggggtaccacacccagaccgcgggcccctggcacctggggaagctggagatggacttcaacttctgcgagggcaccacggtggtcgtgaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtcaccgccggccacgggcagatcgacaacttctccctgggcgtgctgggcatggccctcttcctggaggagatgctgcggacgcgcgtggggaccaagcacgcgatcctcctggtcgccgtgagcttcgtgaccctgatcaccggcaacatgtccttccgggacctcgggcgcgtcatggtgatggtgggcgccacgatgaccgacgacatcgggatgggcgtcacctacctggccctgctcgccgcgttcaaggtgcgccccaccttcgccgccggcctgctgctccggaagctgacgagcaaggagctgatgatgaccaccatcgggatcgtgctcctgtcccagagcaccatccccgagacgatcctggagctcaccgacgccctggccctgggcatgatggtcctcaagatcgtgcgcaacatggagaagtaccagctggcggtcaccatcatggccatcctgtgcgtgccgaacgccgtgatcctccagaacgcctggaaggtctcctgcaccatcctggccgtggtgagcgtcagccccctgctcctgacgagctcccagcagaaggcggactggatccccctggccctcaccatcaaggggctgaaccccaccgccatcttcctgaccacgctcagccggacctccaagaagcgcagctggccgctgaacgaggccatcatggcggtgggcatggtgtccatcctggccagctccctcctgaagaacgacatccccatgaccggccccctggtcgccgggggcctcctgaccgtgtgctacgtgctgacggggcggagcgccgacctcgagctggagcgcgccgcggacgtccggtgggaggaccaggccgagatcagcggctccagccccatcctgtccatcaccatcagcgaggacgggtccatgagcatcaagaacgaggaggaggagcagaccctcaccatcctgatccgcacgggcctgctcgtgatctccggcctgttcccggtgagcatccccatcaccgccgccgcctggtacctgtgggaggtcaagaagcagcgggcgggggtgctctgggacgtgcccagcccgccgcccgtcggcaaggccgagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggcggacgtgaagaaggacctgatcagctacggcgggggctggaagctggagggcgagtggaaggagggggaggaggtgcaggtcctcgccctggagcccggcaagaacccccgggccgtgcagacgaagcccgggctgttcaagaccaacaccggcaccatcggggccgtgtccctcgacttcagccccggcacgtccggcagccccatcgtcgacaagaaggggaaggtggtgggcctgtacgggaacggcgtcgtgacccgctccggcacctacgtgagcgccatcgcgcagaccgagaagtccatcgaggacaaccccgagatcgaggacgacatcttccggaagaagcgcctgacgatcatggacctgcaccccggggccggcaagaccaagcggtacctccccgccatcgtccgcgaggccatcaagcgggggctgcgcaccctgatcctcgcgccgacccgggtggtggccgccgagatggaggaggccctgcgcggcctgcccatccgctaccagacgcccgccatccgggcggagcacaccgggcgcgagatcgtcgacctcatgtgccacgccaccttcaccatgcggctgctgagccccgtgcgcgtgccgaactacaacctcatcatcatggacgaggcccacttcacggaccccgccagcatcgccgcgcggggctacatctccacccgcgtcgagatgggcgaggccgccgggatcttcatgaccgccacgccgcccggcagccgggacccgttcccccagtccaacgcccccatcatggacgaggagcgcgagatccccgagcggagctggaactccgggcacgagtgggtgacggacttcaagggcaagaccgtgtggttcgtcccgagcatcaaggcggggaacgacatcgccgcctgcctgcgcaagaacggcaagaaggtgatccagctgtcccggaagaccttcgacagcgagtacatcaagacccgcacgaacgactgggacttcgtggtcaccaccgacatctccgagatgggcgccaacttcaaggcggagcgggtgatcgacccccgccggtgcatgaagcccgtgatcctcaccgacggggaggagcgcgtcatcctggccggccccatgccggtgacgcacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgcgagaaggtggacgccatcgacggcgagtaccggctgcgcggggaggcccggaagaccttcgtcgacctcatgcgccggggcgacctgcccgtgtggctggcctaccgcgtcgccgcggaggggatcaactacgccgaccggcgctggtgcttcgacggcatcaagaacaaccagatcctcgaggagaacgtggaggtggagatctggaccaaggagggggagcggaagaagctgaagccgcgctggctggacgcccggatctactccgaccccctcgccctgaaggagttcaaggagttcgccgcgggccgcaagagcctgacgctcaacctgatcaccgagatcggccggctgcccaccttcatgacccagaaggcccgcaacgccctcgacaacctggccgtcctgcacacggcggaggccgggggccgggcctacaaccacgccctctccgagctgcccgagaccctggagaccctcctgctgctcaccctgctggccacggtgaccgggggcatcttcctcttcctgatgagcggcaaggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgcggccaccatggccaacgagatgggcttcctggagaagaccaagaaggacttcgggctcggctccatcgccacgcagcagccggagagcaacatcctggacatcgacctgcggcccgccagcgcgtggaccctctacgccgtggccaccaccttcatcacgcccatgctgcgccactccatcgagaacagctccgtgaacgtcagcctgaccgccatcgccaaccaggcgaccgtgctcatgggcctggggaagggctggcccctgtccaagatggacatcggggtgccgctcctggccatcggctgctacagccaggtcaaccccatcaccctgacggccgccctcctgctgctcgtggcgcactacgccatcatcgggcccggcctgcaggccaaggccacccgggaggcccagaagcgcgcggccgccggcatcatgaagaaccccaccgtggacgggatcaccgtcatcgacctggacccgatcccctacgaccccaagttcgagaagcagctcggccaggtgatgctgctggtgctctgcgtcacccaggtgctgatgatgcggaccacctgggccctgtgcgaggccctcaccctggcgacggggcccatctccaccctgtgggagggcaacccggggcgcttctggaacaccaccatcgccgtgagcatggccaacatcttccgcggctcctacctcgccggcgccgggctgctgttcagcatcatgaagaacacggcgaacacccggcgcggcaccgggaacaccggcgagacgctcggcgagaagtggaagaaccggctgaacgccctggggaagtccgagttccagatctacaagaagtccggcatccaggaggtcgaccgcaccctcgccaaggaggggatcaagcggggcgagaccgaccaccacgccgtgtcccgcgggagcgcgaagctgcggtggttcgtggagcgcaacctggtcacccccgagggcaaggtggtggacctcggctgcgggcggggcgggtggtcctactactgcggcgggctgaagaacgtccgcgaggtgaagggcctgacgaagggcgggcccggccacgaggagcccatcccgatgagcacctacgggtggaacctcgtgcggctgcagtccggcgtcgacgtgttcttcacgccgcccgagaagtgcgacaccctgctctgcgacatcggggagagctcccccaacccgacgatcgaggccggccgcaccctgcgggtgctgaacctcgtcgagaactggctgaacaacaacacccagttctgcatcaaggtgctgaacccctacatgcccagcgtgatcgagaagatggaggccctgcagcgcaagtacggcggggccctcgtccggaacccgctgagccgcaactccacccacgagatgtactgggtgagcaacgcctccggcaacatcgtgagctccgtcaacatgatcagccggatgctgatcaaccgcttcaccatgcggcacaagaaggcgacgtacgagcccgacgtggacctcgggtccggcacccgcaacatcgggatcgagagcgagacccccaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtgaacggcgtcgtgcggctgctcaccaagccgtgggacgtgatccccacggtcacccagatggccatgaccgacaccacgcccttcgggcagcagcgcgtgttcaaggagaaggtggacacccggacccaggagcccaaggagggcaccaagaagctgatgaagatcacggccgagtggctgtggaaggagctcggcaagaagaagaccccgcgcatgtgcacccgggaggagttcacccgcaaggtccggagcaacgcggccctgggggccatcttcacggacgagaacaagtggaagtccgcccgcgaggccgtggaggacagccggttctgggagctggtcgacaaggagcgcaacctccacctggagggcaagtgcgagacctgcgtgtacaacatgatggggaagcgggagaagaagctgggcgagttcgggaaggcgaagggctcccgcgccatctggtacatgtggctcggcgcccggttcctggagttcgaggccctggggttcctcaacgaggaccactggttcagccgcgagaactccctgagcggcgtggagggggagggcctgcacaagctcgggtacatcctgcgggacgtcagcaagaaggagggcggcgcgatgtacgccgacgacaccgccgggtgggacacccgcatcacgctggaggacctcaagaacgaggagatggtgaccaaccacatggagggcgagcacaagaagctggccgaggccatcttcaagctgacctaccagaacaaggtggtccgggtgcagcgccccacgccccgggggacggtgatggacatcatctcccgccgggaccagcgcggcagcgggcaggtcggcacctacggcctcaacaccttcaccaacatggaggcgcagctgatccgccagatggagggggagggcgtgttcaagtccatccagcacctgacggtgaccgaggagatcgccgtccagaactggctcgcccgggtggggcgcgagcggctgagccgcatggccatctccggcgacgactgcgtggtcaagcccctggacgaccggttcgccagcgcgctcaccgccctgaacgacatgggcaaggtgcgcaaggacatccagcagtgggagccgtcccgggggtggaacgactggacccaggtgcccttctgcagccaccacttccacgagctgatcatgaaggacggccgcgtcctcgtggtgccctgccggaaccaggacgagctgatcgggcgcgcccggatctcccagggcgccgggtggagcctgcgcgagacggcctgcctcggcaagtcctacgcgcagatgtggagcctgatgtacttccaccggcgcgacctgcggctcgccgccaacgccatctgctccgccgtccccagccactgggtgccgacctcccgcaccacctggagcatccacgcgcggcacgagtggatgaccacggaggacatgctgaccgtgtggaaccgcgtctggatccaggagaacccctggatggaggacaagacccccgtggagtcctgggaggagatcccctacctgggcaagcgggaggaccagtggtgcgggagcctcatcggcctgaccagccgcgccacgtgggccaagaacatccagaccgccatcaaccaggtgcgctccctgatcgggaacgaggagtacaccgactacatgccgagcatgaagcggttccgccgggaggaggaggaggcgggcgtcctctggtga

SEQ ID NO: 9743 - RNA, 9876 nt, synthetic construct
  misc_feature 1..9876: note = derived and/or modified CDS sequence (opt1) from DENV-2__GQ398262__SS-prME
  source 1..9876: mol_type = other RNA
accgccggcatgatcatcatgctgatccccaccgtgatggccttccacctcaccacccgcaacggggagccccacatgatcgtgagccggcaggagaagggcaagtccctgctgttcaagaccgaggacggggtgaacatgtgcaccctcatggcgatggacctgggcgagctgtgcgaggacaccatcacctacaactgccccctcctgcgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcccagcggatcgagacctggatcctgcgccaccccgggttcacgatcatggcggccatcctggcctacaccatcggcaccacctacttccagcgggtcctcatcttcatcctgctgacggccgtggcgccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggccaagctgaccaacacgaccaccgcgagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaaggtggtgcagcccgagaacctggagtacaccatcgtcatcacgccccactccggcgaggagaacgccgtggggaacgacacgggcaagcacgggaaggagatcaagatcaccccgcagagctccatcaccgaggccgagctgaccggctacgggaccgtgacgatggagtgcagcccccgcaccggcctcgacttcaacgagatggtcctgctgcagatggagaacaaggcctggctcgtgcaccggcagtggttcctggacctgcccctcccctggctgccgggcgcggacacccaggggtccaactggatccagaaggagaccctggtgacgttcaagaacccccacgccaagaagcaggacgtcgtggtcctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtgaaggagatcgcggagacccagcacggcaccatcgtcatccgcgtgcagtacgagggggacggcagcccctgcaagatccccttcgagatcatggacctggagaagcggcacgtgctcggccgcctgatcacggtcaacccgatcgtgaccgagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgccaagcggatggccatcctgggcgacacggcctgggacttcgggtccctgggcggggtgttcaccagcatcggcaaggcgctccaccaggtgttcggggccatctacggcgccgccttctccggcgtcagctggaccatgaagatcctgatcggggtggtgatcacctggatcggcatgaactcccgcagcacgtccctgagcgtctccctggtgctcgtgggggtcgtgaccctgtacctgggcgtgatggtccaggcggacagcgggtgcgtggtgtcctggaagaacaaggagctcaagtgcggcagcggcatcttcatcaccgacaacgtccacacctggacggagcagtacaagttccagcccgagagcccctccaagctggccagcgccatccagaaggcccacgaggaggggatctgcggcatccggtccgtgacccgcctggagaacctcatgtggaagcagatcacccccgagctgaaccacatcctgagcgagaacgaggtgcggctcaccatcatgacgggggacatcaagggcatcatgcaggccgggaagcgctccctgcggccgcagcccaccgagctgaagtacagctggaagacctggggcaaggcgaagatgctctccaccgagctgcacaaccagacgttcctgatcgacggccccgagaccgccgagtgcccgaacaccaaccgcgcctggaacagcctcgaggtcgaggactacgggttcggcgtgttcaccacgaacatctggctgaagctgaaggagcggcaggacgtgttctgcgactccaagctcatgagcgccgccatcaaggacaaccgcgcggtccacgccgacatggggtactggatcgagtccgccctgaacgacacctggaagatcgagaaggccagcttcatcgaggtgaagtcctgccactggcccaagagccacaccctgtggtccaacggcgtgctcgagagcgagatgatcatccccaagaacttcgccggccccgtctcccagcacaactaccggccggggtaccacacccagaccgcgggcccctggcacctggggaagctggagatggacttcaacttctgcgagggcacgaccgtggtggtcaccgaggactgcgggaaccgcggccccagcctccggaccacgaccgccagcggcaagctgatcaccgagtggtgctgccgctcctgcaccctgcccccgctccggtaccgcggggaggacggctgctggtacgggatggagatccggcccctgaaggagaaggaggagaacctggtgaacagcctcgtgacggccggccacgggcagatcgacaacttctccctgggcgtcctgggcatggccctcttcctggaggagatgctgcgcacccgggtggggaccaagcacgcgatcctcctggtggccgtcagcttcgtgaccctgatcacgggcaacatgtccttccgcgacctcgggcgcgtgatggtcatggtgggcgccaccatgaccgacgacatcgggatgggcgtgacctacctggccctgctcgccgcgttcaaggtccggcccacgttcgccgccggcctgctgctccgcaagctgaccagcaaggagctgatgatgaccaccatcgggatcgtgctcctgtcccagagcacgatccccgagaccatcctggagctcaccgacgccctggccctgggcatgatggtgctcaagatcgtccggaacatggagaagtaccagctggcggtgaccatcatggccatcctgtgcgtcccgaacgccgtgatcctccagaacgcctggaaggtgtcctgcacgatcctggccgtcgtgagcgtgagccccctgctcctgaccagctcccagcagaaggcggactggatccccctggccctcaccatcaaggggctgaaccccaccgccatcttcctgacgaccctcagccgcacctccaagaagcggagctggccgctgaacgaggccatcatggcggtcggcatggtgtccatcctggccagctccctcctgaagaacgacatccccatgaccggccccctggtggccgggggcctcctgacggtctgctacgtgctgaccgggcgcagcgccgacctcgagctggagcgggccgcggacgtgcgctgggaggaccaggccgagatcagcggctccagccccatcctgtccatcaccatcagcgaggacgggtccatgagcatcaagaacgaggaggaggagcagaccctcacgatcctgatccggaccggcctgctcgtcatctccggcctgttcccggtgagcatccccatcaccgccgccgcctggtacctgtgggaggtgaagaagcagcgcgcgggggtcctctgggacgtgcccagcccgccgcccgtgggcaaggccgagctggaggacggggcctaccggatcaagcagaagggcatcctggggtacagccagatcggcgccggcgtctacaaggaggggaccttccacaccatgtggcacgtgacgcgcggcgccgtgctcatgcacaaggggaagcggatcgagccctcctgggcggacgtcaagaaggacctgatcagctacggcgggggctggaagctggagggcgagtggaaggagggggaggaggtccaggtgctcgccctggagcccggcaagaacccccgcgccgtccagaccaagcccgggctgttcaagaccaacaccggcacgatcggggccgtgtccctcgacttcagccccggcacctccggcagccccatcgtggacaagaaggggaaggtcgtgggcctgtacgggaacggcgtggtcacccggtccggcacctacgtgagcgccatcgcgcagacggagaagtccatcgaggacaaccccgagatcgaggacgacatcttccgcaagaagcggctgaccatcatggacctgcaccccggggccggcaagaccaagcgctacctccccgccatcgtgcgggaggccatcaagcgcgggctgcggaccctgatcctcgcgccgacgcgcgtcgtggccgccgagatggaggaggccctgcgcggcctgcccatccggtaccagacccccgccatccgcgcggagcacaccgggcgggagatcgtggacctcatgtgccacgccaccttcacgatgcgcctgctgagccccgtccgggtgccgaactacaacctcatcatcatggacgaggcccacttcaccgaccccgccagcatcgccgcgcgcggctacatctccacccgggtggagatgggcgaggccgccgggatcttcatgaccgccacgccgcccggcagccgcgacccgttcccccagtccaacgcccccatcatggacgaggagcgggagatccccgagcgcagctggaactccgggcacgagtgggtcaccgacttcaagggcaagaccgtgtggttcgtgccgagcatcaaggcggggaacgacatcgccgcctgcctgcggaagaacggcaagaaggtcatccagctgtcccgcaagaccttcgacagcgagtacatcaagacgcggaccaacgactgggacttcgtggtgaccaccgacatctccgagatgggcgccaacttcaaggcggagcgcgtcatcgacccccggcgctgcatgaagcccgtgatcctcacggacggggaggagcgggtgatcctggccggccccatgccggtcacccacagctccgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgggagaaggtggacgccatcgacggcgagtaccgcctgcgcggggaggcccgcaagaccttcgtggacctcatgcggcgcggcgacctgcccgtctggctggcctaccgggtggccgcggaggggatcaactacgccgaccgccggtggtgcttcgacggcatcaagaacaaccagatcctcgaggagaacgtcgaggtggagatctggacgaaggagggggagcgcaagaagctgaagccgcggtggctggacgcccgcatctactccgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgcggaggccgggggccgcgcctacaaccacgccctctccgagctgcccgagaccctggagaccctcctgctgctcacgctgctggccaccgtcaccgggggcatcttcctcttcctgatgagcggcaaggggatcggcaagatgaccctggggatgtgctgcatcatcaccgcgtccatcctcctgtggtacgcccagatccagccgcactggatcgccgccagcatcatcctggagttcttcctcatcgtgctgctgatccccgagcccgagaagcagcggacgccccaggacaaccagctcacctacgtggtcatcgccatcctgaccgtggtggcggccaccatggccaacgagatgggcttcctggagaagacgaagaaggacttcgggctcggctccatcgccacccagcagccggagagcaacatcctggacatcgacctgcgccccgccagcgcgtggaccctctacgccgtcgccaccacgttcatcacccccatgctgcggcactccatcgagaacagctccgtgaacgtgagcctgaccgccatcgccaaccaggcgaccgtcctcatgggcctggggaagggctggcccctgtccaagatggacatcggggtgccgctcctggccatcggctgctacagccaggtgaaccccatcacgctgaccgccgccctcctgctgctcgtcgcgcactacgccatcatcgggcccggcctgcaggccaaggccacccgcgaggcccagaagcgggcggccgccggcatcatgaagaaccccaccgtggacgggatcacggtgatcgacctggacccgatcccctacgaccccaagttcgagaagcagctcggccaggtcatgctgctggtgctctgcgtgacccaggtcctgatgatgcgcaccacctgggccctgtgcgaggccctcacgctggcgaccgggcccatctccaccctgtgggagggcaacccggggcgcttctggaacaccacgatcgccgtgagcatggccaacatcttccggggctcctacctcgccggcgccgggctgctgttcagcatcatgaagaacaccgcgaacacccgccggggcaccgggaacacgggcgagaccctcggcgagaagtggaagaaccgcctgaacgccctggggaagtccgagttccagatctacaagaagtccggcatccaggaggtggaccggaccctcgccaaggaggggatcaagcgcggcgagaccgaccaccacgccgtctcccgggggagcgcgaagctgcgctggttcgtggagcggaacctggtgacgcccgagggcaaggtcgtggacctcggctgcgggcgcggcgggtggtcctactactgcggcgggctgaagaacgtgcgggaggtcaagggcctgaccaagggcgggcccggccacgaggagcccatcccgatgagcacctacgggtggaacctcgtgcgcctgcagtccggcgtggacgtcttcttcacgccgcccgagaagtgcgacacgctgctctgcgacatcggggagagctcccccaacccgaccgtggaggccggccggaccctgcgcgtgctgaacctcgtcgagaactggctgaacaacaacacccagttctgcatcaaggtgctgaacccctacatgcccagcgtgatcgagaagatggaggccctgcagcggaagtacggcggggccctcgtccgcaacccgctgagccggaactccacccacgagatgtactgggtgagcaacgcctccggcaacatcgtgagctccgtcaacatgatcagccgcatgctgatcaaccggttcacgatgcgccacaagaaggcgacctacgagcccgacgtggacctcgggtccggcacccgcaacatcgggatcgagagcgagacccccaacctggacatcatcggcaagcggatcgagaagatcaagcaggagcacgagacgtcctggcactacgaccaggaccacccctacaagacctgggcctaccacggcagctacgagaccaagcagaccgggtccgccagctccatggtgaacggcgtcgtgcgcctgctcacgaagccgtgggacgtgatccccatggtcacccagatggccatgaccgacaccacgcccttcgggcagcagcgggtgttcaaggagaaggtggacacccgcacccaggagcccaaggagggcaccaagaagctgatgaagatcacggccgagtggctgtggaaggagctcggcaagaagaagaccccgcggatgtgcacccgcgaggagttcacccggaaggtccgcagcaacgcggccctgggggccatcttcacggacgagaacaagtggaagtccgcccgggaggccgtggaggacagccgcttctgggagctggtcgacaaggagcggaacctccacctggagggcaagtgcgagacctgcgtgtacaacatgatggggaagcgcgagaagaagctgggcgagttcgggaaggcgaagggctcccgggccatctggtacatgtggctcggcgcccgcttcctggagttcgaggccctggggttcctcaacgaggaccactggttcagccgggagaactccctgagcggcgtggagggggagggcctgcacaagctcgggtacatcctgcgcgacgtcagcaagaaggagggcggcgcgatgtacgccgacgacaccgccgggtgggacacccggatcacgctggaggacctcaagaacgaggagatggtgaccaaccacatggagggcgagcacaagaagctggccgaggccatcttcaagctgacctaccagaacaaggtggtccgcgtgcagcggcccacgccccgggggacggtgatggacatcatctcccggcgcgaccagcgcggcagcgggcaggtcggcacctacggcctcaacaccttcaccaacatggaggcgcagctgatccggcagatggagggggagggcgtgttcaagtccatccagcacctgacggtgaccgaggagatcgccgtccagaactggctcgcccgcgtggggcgggagcgcctgagccggatggccatctccggcgacgactgcgtggtcaagcccctggacgaccgcttcgccagcgcgctcaccgccctgaacgacatgggcaaggtgcggaaggacatccagcagtgggagccgtcccgcgggtggaacgactggacccaggtgcccttctgcagccaccacttccacgagctgatcatgaaggacggccgggtcctcgtggtgccctgccgcaaccaggacgagctgatcgggcgggcccgcatctcccagggcgccgggtggagcctgcgggagacggcctgcctcggcaagtcctacgcgcagatgtggagcctgatgtacttccaccgccgggacctgcgcctcgccgccaacgccatctgctccgccgtccccagccactgggtgccgacctcccggaccacctggagcatccacgcgcgccacgagtggatgaccacggaggacatgctgaccgtgtggaaccgggtctggatccaggagaacccctggatggaggacaagacccccgtggagtcctgggaggagatcccctacctgggcaagcgcgaggaccagtggtgcgggagcctcatcggcctgaccagccgcgccacgtgggccaagaacatccagaccgccatcaaccaggtgcggtccctgatcgggaacgaggagtacaccgactacatgccgagcatgaagcgcttccggcgcgaggaggaggaggcgggcgtcctctggtga
